US011807867B2

(12) United States Patent
Simons et al.

(10) Patent No.: US 11,807,867 B2
(45) Date of Patent: Nov. 7, 2023

(54) COMPOSITIONS AND METHODS FOR TREATING NON-AGE-ASSOCIATED HEARING IMPAIRMENT IN A HUMAN SUBJECT

(71) Applicant: Akouos, Inc., Boston, MA (US)

(72) Inventors: Emmanuel John Simons, Boston, MA (US); Robert Ng, Boston, MA (US)

(73) Assignee: Akouos, Inc., Boston, MA (US)

( * ) Notice: Subject to any disclaimer, the term of this patent is extended or adjusted under 35 U.S.C. 154(b) by 0 days.

(21) Appl. No.: 17/816,305

(22) Filed: Jul. 29, 2022

(65) Prior Publication Data
US 2023/0108913 A1 Apr. 6, 2023

Related U.S. Application Data

(63) Continuation of application No. PCT/US2021/018919, filed on Feb. 19, 2021.

(60) Provisional application No. 62/979,792, filed on Feb. 21, 2020.

(51) Int. Cl.
*C12N 15/86* (2006.01)
*A61P 27/16* (2006.01)
*C07K 14/47* (2006.01)
*A61K 48/00* (2006.01)

(52) U.S. Cl.
CPC .............. *C12N 15/86* (2013.01); *A61P 27/16* (2018.01); *C07K 14/47* (2013.01); *A61K 48/00* (2013.01); *C12N 2750/14143* (2013.01); *C12N 2750/14144* (2013.01)

(58) Field of Classification Search
None
See application file for complete search history.

(56) References Cited

U.S. PATENT DOCUMENTS

| | | | |
|---|---|---|---|
| 4,075,196 A | 2/1978 | Badertscher et al. | |
| 5,122,458 A | 6/1992 | Post et al. | |
| 5,168,062 A | 12/1992 | Stinski et al. | |
| 5,510,118 A | 4/1996 | Bosch et al. | |
| 5,552,157 A | 9/1996 | Yagi et al. | |
| 5,565,213 A | 10/1996 | Nakamori et al. | |
| 5,567,434 A | 10/1996 | Szoka, Jr. | |
| 5,651,991 A | 7/1997 | Sugiyama et al. | |
| 5,656,016 A | 8/1997 | Ogden | |
| 5,697,899 A | 12/1997 | Hillman et al. | |
| 5,738,868 A | 4/1998 | Shinkarenko | |
| 5,741,516 A | 4/1998 | Webb et al. | |
| 5,770,219 A | 6/1998 | Chiang et al. | |
| 5,779,708 A | 7/1998 | Wu | |
| 5,783,208 A | 7/1998 | Venkateshwaran et al. | |
| 5,795,587 A | 8/1998 | Gao et al. | |
| 5,797,898 A | 8/1998 | Santini, Jr. et al. | |
| 5,851,452 A | 12/1998 | Vallet Mas et al. | |
| 6,007,856 A | 12/1999 | Cox et al. | |
| 6,265,180 B1 | 7/2001 | Zuelli et al. | |
| 6,274,150 B1 | 8/2001 | Simonnet et al. | |
| 7,419,817 B2 | 9/2008 | Chiorini et al. | |
| 7,851,196 B2 | 12/2010 | Schaffer et al. | |
| 8,236,557 B2 | 8/2012 | Dongsheng et al. | |
| 8,507,270 B2 | 8/2013 | Yamaguchi et al. | |
| 8,591,457 B2 | 11/2013 | Gilbert | |
| 8,647,841 B2 | 2/2014 | Bauer et al. | |
| 9,249,417 B2 | 2/2016 | Yamaguchi et al. | |
| 9,695,220 B2 | 7/2017 | Vandenberghe et al. | |
| 9,719,070 B2 | 8/2017 | Vandenberghe et al. | |
| 10,119,125 B2 | 11/2018 | Vandenberghe et al. | |
| 10,494,645 B2 | 12/2019 | Auricchio et al. | |
| 10,526,584 B2 | 1/2020 | Vandenberghe et al. | |
| 11,125,139 B2* | 9/2021 | Ernst | F01K 7/18 |
| 11,525,139 B2 | 11/2022 | Simons et al. | |
| 11,660,353 B2 | 5/2023 | Burns et al. | |
| 2003/0194412 A1 | 10/2003 | Baker et al. | |
| 2004/0005370 A1 | 1/2004 | Breton | |
| 2004/0048836 A1 | 3/2004 | Wilmott | |
| 2004/0115159 A1 | 6/2004 | Tadlock et al. | |
| 2004/0116512 A1 | 6/2004 | Naguib et al. | |
| 2004/0127661 A1 | 7/2004 | Kaspar et al. | |
| 2005/0096340 A1 | 5/2005 | Zhang et al. | |
| 2005/0184275 A1 | 8/2005 | Mora-Gutierrez et al. | |
| 2006/0040354 A1 | 2/2006 | O'Keefe | |
| 2013/0095071 A1 | 4/2013 | Bance et al. | |
| 2016/0076054 A1 | 3/2016 | Auricchio et al. | |

(Continued)

FOREIGN PATENT DOCUMENTS

CN 113337507 A 11/2021
EP 1249232 A1 10/2002

(Continued)

OTHER PUBLICATIONS

Ame, J.C., et al., "A Bidirectional Promoter Connects the Poly(ADP-ribose) Polymerase 2 (PARP-2) Gene to the Gene for RNAse P. RNA Structure and Expression of the Mouse PARP-2 Gene," The Journal of Biological Chemistry 276(14):11092-11099, Elsevier Inc., United States (Apr. 2001).

Boeda, B., et al., "A Specific Promoter of the Sensory Cells of the Inner Ear Defined by Transgenesis," Human Molecular Genetics 10(15):1581-1589, Oxford University Press, United Kingdom (Jul. 2001).

Brene, S., et al., "Regulation of GluR2 Promoter Activity by Neurotrophic Factors via a Neuron-restrictive Silencer Element," The European Journal of Neuroscience 12(5):1525-1533, Wiley-Blackwell, France (May 2000).

Carter, B.J., "Handbook of Parvoviruses," ed., P. Tijsser, CRC Press, pp. 155-168, United States (1990).

(Continued)

*Primary Examiner* — Robert M Kelly
(74) *Attorney, Agent, or Firm* — Sterne, Kessler, Goldstein & Fox P.L.L.C.

(57) ABSTRACT

Provided herein are compositions that include at least two different nucleic acid vectors, where each of the at least two different vectors includes a coding sequence that encodes a different portion of an otoferlin protein, and the use of these compositions to treat hearing loss in a subject.

28 Claims, 52 Drawing Sheets

Specification includes a Sequence Listing.

(56) References Cited

U.S. PATENT DOCUMENTS

| | | |
|---|---|---|
| 2018/0055908 A1 | 3/2018 | Petit et al. |
| 2018/0369414 A1 | 12/2018 | Stankovic et al. |
| 2019/0076623 A1 | 3/2019 | Mackay et al. |
| 2019/0100560 A1 | 4/2019 | Vandenberghe et al. |
| 2019/0185864 A1 | 6/2019 | Simons et al. |
| 2020/0101122 A1 | 4/2020 | Cheng et al. |
| 2020/0123504 A1 | 4/2020 | Vandenberghe et al. |
| 2020/0390905 A1 | 12/2020 | Simons et al. |
| 2021/0023242 A1 | 1/2021 | Moser et al. |
| 2021/0095313 A1 | 4/2021 | Bartolome |
| 2021/0363534 A1 | 7/2021 | Simons et al. |
| 2021/0284699 A1 | 9/2021 | Gradinaru et al. |
| 2021/0355171 A1 | 11/2021 | Tan et al. |
| 2021/0355504 A1 | 11/2021 | Burns et al. |
| 2021/0388045 A1 | 12/2021 | Burns et al. |
| 2021/0395778 A1 | 12/2021 | Dyka et al. |
| 2021/0395781 A1 | 12/2021 | Burns et al. |
| 2022/0040327 A1 | 2/2022 | Simons et al. |
| 2022/0265855 A1 | 8/2022 | Bachmann et al. |
| 2022/0378945 A1 | 12/2022 | Meyer et al. |
| 2023/0073250 A1 | 3/2023 | Anderson et al. |
| 2023/0090778 A1 | 3/2023 | Holt et al. |
| 2023/0116688 A1 | 4/2023 | Frutos Domínguez et al. |

FOREIGN PATENT DOCUMENTS

| | | |
|---|---|---|
| JP | H07285863 A | 10/1995 |
| JP | H08507515 A | 8/1996 |
| JP | 2001513331 A | 9/2001 |
| JP | 2003527411 A | 9/2003 |
| JP | 2004532214 A | 10/2004 |
| JP | 2012511307 A | 5/2012 |
| WO | WO-9420072 A1 | 9/1994 |
| WO | WO-9810088 A1 | 3/1998 |
| WO | WO-9960146 A1 | 11/1999 |
| WO | WO-0032233 A2 | 6/2000 |
| WO | WO-0046354 A1 | 8/2000 |
| WO | WO-0055342 A1 | 9/2000 |
| WO | WO-0125253 A2 | 4/2001 |
| WO | WO-0149829 A1 | 7/2001 |
| WO | WO-0166782 A1 | 9/2001 |
| WO | WO-0170972 A2 | 9/2001 |
| WO | WO-2001070197 A2 | 9/2001 |
| WO | WO-0202175 A1 | 1/2002 |
| WO | WO-0212455 A1 | 2/2002 |
| WO | WO-0212525 A2 | 2/2002 |
| WO | WO-02080864 A1 | 10/2002 |
| WO | WO-03014367 A1 | 2/2003 |
| WO | WO-03093295 A2 | 11/2003 |
| WO | WO-2004113494 A2 | 12/2004 |
| WO | WO-2005009287 A1 | 2/2005 |
| WO | WO-2005013938 A1 | 2/2005 |
| WO | WO-2005020962 A1 | 3/2005 |
| WO | WO-2005027872 A2 | 3/2005 |
| WO | WO-2005042539 A1 | 5/2005 |
| WO | WO-2005073384 A2 | 8/2005 |
| WO | WO-2005118792 A1 | 12/2005 |
| WO | WO-2006012414 A2 | 2/2006 |
| WO | WO-2006033689 A2 | 3/2006 |
| WO | WO-2007046703 A2 | 4/2007 |
| WO | WO-2007127264 A2 | 11/2007 |
| WO | WO-2007148971 A2 | 12/2007 |
| WO | WO-2008030485 A2 | 3/2008 |
| WO | WO-2008045242 A2 | 4/2008 |
| WO | WO-2009014445 A2 | 1/2009 |
| WO | WO-2009021017 A2 | 2/2009 |
| WO | WO-2010148143 A1 | 12/2010 |
| WO | WO-2011094198 A1 | 8/2011 |
| WO | WO-2011112089 A2 | 9/2011 |
| WO | WO-2012022920 A1 | 2/2012 |
| WO | WO-2012123430 A1 | 9/2012 |
| WO | WO-2013063379 A1 | 5/2013 |
| WO | WO-2013075008 A1 | 5/2013 |
| WO | WO-2013123503 A1 | 8/2013 |
| WO | WO-2014145599 A2 | 9/2014 |
| WO | WO-2014170480 A1 | 10/2014 |
| WO | WO-2015031686 A9 | 4/2015 |
| WO | WO-2015054653 A2 | 4/2015 |
| WO | WO-2015137802 A1 | 9/2015 |
| WO | WO-2016004319 A1 | 1/2016 |
| WO | WO-2016114992 A2 | 7/2016 |
| WO | WO-2016128407 A1 | 8/2016 |
| WO | WO-2016139321 A1 | 9/2016 |
| WO | WO-2016144892 A1 | 9/2016 |
| WO | WO-2017019994 A2 | 2/2017 |
| WO | WO-2017096039 A1 | 6/2017 |
| WO | WO-2017100791 A1 | 6/2017 |
| WO | WO-2017108931 A1 | 6/2017 |
| WO | WO-2017132530 A1 | 8/2017 |
| WO | WO-2017136764 A1 | 8/2017 |
| WO | WO-2017223193 A1 | 12/2017 |
| WO | WO-2018011599 A2 | 1/2018 |
| WO | WO-2018017956 A2 | 1/2018 |
| WO | WO-2018022608 A2 | 2/2018 |
| WO | WO-2018039375 A1 | 3/2018 |
| WO | WO-2018089192 A1 | 5/2018 |
| WO | WO-2018128688 A1 | 7/2018 |
| WO | WO-2018204734 A1 | 11/2018 |
| WO | WO-2018204786 A1 | 11/2018 |
| WO | WO-2018204797 A1 | 11/2018 |
| WO | WO-2018204803 A1 | 11/2018 |
| WO | WO-2018232055 A1 | 12/2018 |
| WO | WO-2019028306 A2 | 2/2019 |
| WO | WO-2019084145 A1 | 5/2019 |
| WO | WO-2019143272 A1 | 7/2019 |
| WO | WO-2019157370 A1 | 8/2019 |
| WO | WO-2019162396 A1 | 8/2019 |
| WO | WO-2019165292 A1 | 8/2019 |
| WO | WO-2019173367 A1 | 9/2019 |
| WO | WO-2018145111 A9 | 10/2019 |
| WO | WO-2019210181 A1 | 10/2019 |
| WO | WO-2019222328 A1 | 11/2019 |
| WO | WO-2019222329 A1 | 11/2019 |
| WO | WO-2020014479 A1 | 1/2020 |
| WO | WO-2020023612 A1 | 1/2020 |
| WO | WO-2020069320 A1 | 4/2020 |
| WO | WO-2020097372 A1 | 5/2020 |
| WO | WO-2020148458 A1 | 7/2020 |
| WO | WO-2020163761 A1 | 8/2020 |
| WO | WO-2020223933 A1 | 11/2020 |
| WO | WO-2021077115 A1 | 4/2021 |
| WO | WO-2021087296 A1 | 5/2021 |
| WO | WO-2021150850 A1 | 7/2021 |
| WO | WO-2021168362 A1 | 8/2021 |
| WO | WO-2021179861 A1 | 9/2021 |
| WO | WO-2022056440 A1 | 3/2022 |
| WO | WO-2022099007 A1 | 5/2022 |
| WO | WO-2022117797 A1 | 6/2022 |
| WO | WO-2022178298 A1 | 8/2022 |

OTHER PUBLICATIONS

Cunningham, S.C., et al., "Gene Delivery to the Juvenile Mouse Liver Using AAV2/8 Vectors," Molecular Therapy 16(6):1081-1088, Cell Press, United States (Jun. 2008).

Dirren, E., et al., "Intracerebroventricular Injection of Adeno-associated Virus 6 and 9 Vectors for Cell Type-specific Transgene Expression in the Spinal Cord," Human Gene Therapy 25(2):109-120, Mary Ann Liebert Inc., United States (Feb. 2014).

GenBank, "*Homo sapiens* Otoferlin (OTOF) mRNA, Complete Cds," Accession No. AF107403.1, accessed at https://www.ncbi.nlm.nih.gov/nuccore/AF107403.1, accessed on Jul. 20, 2021, 3 pages.

GenBank, "*Homo sapiens* otoferlin (OTOF), RefSeqGene on chromosome 2," Accession No. NG_009937.1, accessed at https://www.ncbi.nlm.nih.gov/nuccore/224465243, accessed on Jul. 20, 2021, 29 pages.

GenBank, "*Homo sapiens* otoferlin (OTOF), transcript variant 1, mRNA," NCBI Reference Sequence: NM_194248.2, accessed at https://www.ncbi.nlm.nih.gov/nuccore/NM_194248.2, accessed on Jul. 20, 2021, 7 pages.

(56) References Cited

OTHER PUBLICATIONS

GenBank, "*Homo sapiens* otoferlin (OTOF), transcript variant 2, mRNA," NCBI Reference Sequence: NM_004802.3, accessed at https://www.ncbi.nlm.nih.gov/nuccore/NM_004802.3, accessed on Jul. 20, 2021, 6 pages.

GenBank, "*Homo sapiens* otoferlin (OTOF), transcript variant 3, mRNA," NCBI Reference Sequence: NM_194322.2, accessed at https://www.ncbi.nlm.nih.gov/nuccore/NM_194322.2, accessed on Jul. 20, 2021, 6 pages.

GenBank, "*Homo sapiens* otoferlin (OTOF), transcript variant 4, mRNA," NCBI Reference Sequence: NM_194323.2, accessed at https://www.ncbi.nlm.nih.gov/nuccore/NM_194323.2, accessed on Jul. 20, 2021, 6 pages.

GenBank, "*Homo sapiens* otoferlin (OTOF), transcript variant 5, mRNA," NCBI Reference Sequence: NM_001287489.2, accessed at https://www.ncbi.nlm.nih.gov/nuccore/NM_001287489, accessed on Jul. 20, 2021, 7 pages.

GenBank, "Human Elongation Factor EF-1-alpha Gene, Complete Cds," Accession No. J04617.1, accessed at https://www.ncbi.nlm.nih.gov/nuccore/J04617.1, accessed on Jul. 20, 2021, 3 pages.

GenBank, "Human gene for H1 RNA," Accession No. X16612.1, accessed at https://www.ncbi.nlm.nih.gov/nuccore/X16612.1, accessed on Jul. 20, 2021, 2 pages.

GenBank, "Mus Musculus Myosin Viia Gene, Promoter and Partial Cds," Accession No. AF384559.1, accessed at https://www.ncbi.nlm.nih.gov/nuccore/AF384559.1, accessed on Jul. 20, 2021, 2 pages.

GenBank, "Mus Musculus Poly (Adp-ribose) Polymerase 2 (Parp2) Gene, Complete Cds," Accession No. AF191547.1, accessed at https://www.ncbi.nlm.nih.gov/nuccore/AF191547.1, accessed on Jul. 20, 2021, 5 pages.

GenBank, "Mus Musculus Strain C57BL/6J Chromosome 5, GRCm38.p6 C57BL/6J," NCBI Reference Sequence: NC_000071.6, accessed at https://www.ncbi.nlm.nih.gov/nuccore/NC_000071.6, accessed on Jul. 22, 2021, 2 pages.

GenBank, "Neurotrophin 3, Isoform CRA_b [*Homo sapiens*]," GenBank: EAW88825.1, Mar. 2015, https://www.ncbi.nlm.nih.gov/protein/119609231/, accessed on Jul. 21, 2021, 2 pages.

Gene ID: 459083, "OTOF otoferlin [*Pan troglodytes* (chimpanzee)]," accessed at https://www.ncbi.nlm.nih.gov/gene/459083, accessed on Jul. 20, 2021, 5 pages.

Gene ID: 557476, "otofa otoferlin a [*Danio rerio* (zebrafish)]," accessed at https://www.ncbi.nlm.nih.gov/gene/557476, accessed on Jul. 20, 2021, 12 pages.

Gene ID: 696717 "OTOF otoferlin [*Macaca mulatta* (Rhesus monkey)]", Accession No. 027905 REGION:complement (26723411..26826586), www.ncbi.nlm.nih.gov/gene/696717, accessed on Jul. 20, 2021, 6 pages.

Gene ID: 83762 "Otof otoferlin [*Mus musculus* (house mouse)]," accessed at https://www.ncbi.nlm.nih.gov/gene/83762, accessed on Jul. 20, 2021, 12 pages.

GenPept, "Mus musculus otoferlin (Otof), transcript variant 4, mRNA," Accession No. NM_001313767.1, accessed at https://www.ncbi.nlm.nih.gov/nuccore/NM_001313767.1, accessed on Jul. 20, 2021, 7 pages.

GenPept, "otoferlin [*Homo sapiens*]," Accession No. AAD26117.1, accessed at https://www.ncbi.nlm.nih.gov/protein/AAD26117.1, accessed on Jul. 20, 2021, 2 pages.

GenPept, "otoferlin isoform 4 [Mus musculus]," Accession No. NP_001300696.1, accessed at https://www.ncbi.nlm.nih.gov/protein/NP_001300696.1, accessed on Jul. 20, 2021, 4 pages.

GenPept, "otoferlin isoform b [*Homo sapiens*]," Accession No. NP_004793.2, accessed at https://www.ncbi.nlm.nih.gov/protein/NP_004793.2, accessed on Jul. 20, 2021, 3 pages.

GenPept, "otoferlin isoform c [*Homo sapiens*]," Accession No. NP_919303.1, accessed at https://www.ncbi.nlm.nih.gov/protein/NP_919303.1, accessed on Jul. 20, 2021, 3 pages.

GenPept, "otoferlin isoform d [*Homo sapiens*]," Accession No. NP_919304.1, accessed at https://www.ncbi.nlm.nih.gov/protein/NP_919304.1, accessed on Jul. 20, 2021, 3 pages.

GenPept, "otoferlin isoform e [*Homo sapiens*]," Accession No. NP_001274418.1, accessed at https://www.ncbi.nlm.nih.gov/protein/NP_001274418.1 accessed on Jul. 20, 2021, 4 pages.

Gray, S. J., "Optimizing Promoters for Recombinant Adeno-Associated Virus-Mediated Gene Expression in the Peripheral and Central Nervous System Using Self-Complementary Vectors," Human Gene Therapy 22(9):1143-1153, Mary Ann Liebert Inc., United States (Sep. 2011).

Iwamoto, M., et al., "A General Chemical Method to Regulate Protein Stability in the Mammalian Central Nervous System," Chemistry & Biology 17(9):981-988, Elsevier, United States (Sep. 2010).

Kugler, S., et al., "Differential Transgene Expression in Brain Cells in Vivo and in Vitro From AAV-2 Vectors With Small Transcriptional Control Units," Virology 311(1):89-95, Academic Press, United States (Jun. 2003).

Liu, Y., et al., "Promoter Effects of Adeno-associated Viral Vector for Transgene Expression in the Cochlea in Vivo," Experimental & Molecular Medicine 39(2):170-175, Nature Publishing Group, United States (Apr. 2007).

Ohlfest, J.R., et al., "Phenotypic Correction and Long-term Expression of Factor Viii in Hemophilic Mice by Immunotolerization and Nonviral Gene Transfer Using the Sleeping Beauty Transposon System," Blood 105(7):2691-2698, Elsevier, United States (Apr. 2005).

Powell, S.K., et al., "Viral Expression Cassette Elements to Enhance Transgene Target Specificity and Expression in Gene Therapy," Discovery Medicine 19(102):49-57, Discovery Medicine, United States (Jan. 2015).

Remington's Pharmaceutical Sciences, 15th Edition, pp. 1035-1038 and 1570-1580, Osol, A., and Hoover, J. E., eds., Mack Publishing Co., United States (1975).

Stone, I.M., et al. "Adeno-Associated Virus-Mediated Gene Transfer to Hair Cells and Support Cells of The Murine Cochlea," Molecular therapy: The Journal of the American Society of Gene Therapy (6):843-848, American Society of Gene & Cell Therapy, United States (Jun. 2005).

Su, Z.Z., et al., "Insights Into Glutamate Transport Regulation in Human Astrocytes: Cloning of the Promoter for Excitatory Amino Acid Transporter 2 (EAAT2)," Proceedings of the National Academy of Sciences of the United States of America 100(4):1955-1960, National Academy of Sciences, United States (Feb. 2003).

Talbot, G.E., "Desmin-Regulated Lentiviral Vectors for Skeletal Muscle Gene Transfer," Molecular therapy: The Journal of the American Society of Gene Therapy 18(3):601-608, Cell Press, United States (Mar. 2010).

Xu, L., et al., "Cmv-Beta-Actin Promoter Directs Higher Expression From an Adeno-Associated Viral Vector in the Liver Than the Cytomegalovirus or Elongation Factor 1 Alpha Promoter and Results in Therapeutic Levels of Human Factor X in Mice," Human Gene Therapy 12(5):563-573, M.A, Liebert, United States (Mar. 2001).

Yasunaga, S., et al., "A Mutation in OTOF, Encoding Otoferlin, a FER-1-like Protein, Causes DFNB9, a Nonsyndromic Form of Deafness," Nature Genetics 21(4):363-369, Nature Pub. Co., United States (Apr. 1999).

Wu, C., et al. "Identifying children with poor cochlear implantation outcomes using massively parallel sequencing," Medicine 94(27): e1073. Wolter Kluwer Health, United States (2015).

Zhang, W., et al. "Cochlear gene therapy for sensorineural hearing loss: current status and major remaining hurdles for translational success." Frontiers in molecular neuroscience 11: 221, Frontiers Media, United States (2018).

Lee, M.Y., and Park, Y.H., "Potential of gene and cell therapy for inner ear hair cells." BioMed Research International 2018: 8137614, 11 pages, Hindawi, United Kingdom (2018).

GenBank, "Mus musculus otoferlin (Otof), transcript variant 1, mRNA," Accession No. NM_001100395.1, accessed at https://www.ncbi.nlm.nih.gov/nuccore/154240701?sat=46&satkey=70798641, accessed on Sep. 16, 2021, 4 pages.

Choi, J., et al., "Optimization of AAV Expression Cassettes to Improve Packaging Capacity and Transgene Expression in Neurons," Molecular Brain 7:17, BioMed Central, United Kingdom (Mar. 2014).

(56) References Cited

OTHER PUBLICATIONS

Gait, M. J., "Oligonucleotide Synthesis: a Practical Approach," Practical Approach Series, Oxford, United States (1984).

Allocca, M., et al., "Serotype-dependent packaging of large genes in adeno-associated viral vectors results in effective gene delivery in mice," Journal of Clinical Investigation 118(50):1955-1964, American Society for Clinical Investigation, United States (2008).

Liu, M., et al., "Adeno-Associated Virus-Mediated Microdystrophin Expression Protects Young mdx Muscle from Contraction-Induced Injury," Molecular Therapy 11(2):245-256, American Society of Gene Therapy, United States (2005).

McClements, M.E., and MaClaren, R.E., "Adeno-associated Virus (AAV) Dual Vector Strategies for Gene Therapy Encoding Large Transgenes," Yale Journal of Biology and Medicine 9:611-623, United States (2017).

Rankovic, V., et al., "Overloaded Adeno-Associated Virus as a Novel Gene Therapeutic Tool for Otoferlin-Related Deafness," Frontiers in Molecular Neuroscience 13:600051, Frontiers Media, Switzerland (Jan. 2021).

Qui, Y., et al., "Auditory Neuropathy Spectrum Disorder due to Two Novel Compound Heterozygous OTOF Mutations in Two Chinese Families," Neural Plasticity 2019:9765276, Hindawi, United Kingdom (Nov. 2019).

Iyama, T., et al., "DNA repair mechanisms in dividing and non-dividing cells," DNA Repair 12(8):620-636, Elsevier, Netherlands (2013).

Xia, et al., "Local gene transfection in the cochlea (Review)," Molecular Medicine Reports 8:3-10, Spandidos Publications, Greece (2013).

Akil, O., et al., "Dual AAV-mediated Gene Therapy Restores Hearing in a Dfnb9 Mouse Model," Proceedings of the National Academy of Sciences of the United States of America 116(10):4496-4501, National Academy of Sciences, United States (Mar. 2019).

Akil, O., et al., "Restoration of Hearing in the VGLUT3 Knockout Mouse Using Virally Mediated Gene Therapy," Neuron 75(2):283-293, Cell Press, United States (Jul. 2012).

Alemi, A., "AOS Research Grant: Restoration of Hearing in the Otoferlin Knockout Mouse Using Viral Gene Therapy", American Otological Society INC 145th Annual Meeting, Manchester Grand Hyatt, San Diego, United States (Apr. 2012).

Al-Moyed, H., et al., "A Dual-AAV Approach Restores Fast Exocytosis and Partially Rescues Auditory Function in Deaf Otoferlin Knock-out Mice," EMBO Molecular Medicine 11(1):e9396, Wiley-Blackwell, United Kingdom (Jan. 2019).

Andersen, J.K., et al., "Herpesvirus-mediated Gene Delivery Into the Rat Brain: Specificity and Efficiency of the Neuron-specific Enolase Promoter," Cellular and Molecular Neurobiology 13(5):503-515, Kluwer Academic/Plenum Publishers, United States (Oct. 1993).

Arbuthnot, P.B., et al., "In Vitro and in Vivo Hepatoma Cell-specific Expression of a Gene Transferred With an Adenoviral Vector," Human Gene Therapy 7(13):1503-1514, Mary Ann Liebert Inc., United States (Aug. 1996).

Asai, H., et al., "Depletion of Microglia and Inhibition of Exosome Synthesis Halt Tau Propagation," Nature Neuroscience 18(11):1584-1593, Nature America Inc., United States (Nov. 2015).

Asokan, A., et al., "The AAV Vector Toolkit: Poised at the Clinical Crossroads," Molecular Therapy 20(4):699-708, Cell Press, United States (Apr. 2012).

Azaiez, H., et al., "Genotype-phenotype Correlations for SLC26A4-related Deafness," Human Genetics 122(5):451-457, Springer Verlag, Germany (Dec. 2007).

Baker, K., et al., "Repair of the Vestibular System via Adenovector Delivery of Atoh1: a Potential Treatment for Balance Disorders," Adv. Otorhinolaryngol. 66:52-63, Basel, Karger, Switzerland (2009).

Banasik, M.B., and McCray Jr., P.B., "Integrase-defective Lentiviral Vectors: Progress and Applications," Gene Therapy 17(2):150-157, Nature Publishing Group, United Kingdom (Oct. 2009).

Bartoli, M., et al., "Noninvasive Monitoring of Therapeutic Gene Transfer in Animal Models of Muscular Dystrophies," Gene Therapy 13(1):20-28, Nature Publishing Group, United Kingdom (Jan. 2006).

Basu, J., et al., "Human Artificial Chromosomes: Potential Applications and Clinical Considerations," Pediatric Clinics of North America 53(5):843-853, W.B. Saunders, United States (Oct. 2006).

Batt, D.B. and Carmichael, G.G., "Characterization of the Polyomavirus Late Polyadenylation Signal," Molecular and Cellular Biology 15(9):4783-4790, American Society for Microbiology, United States (Sep. 1995).

Batzer, M.A., et al., "Enhanced evolutionary PCR using oligonucleotides with inosine at the 3'-terminus," Nucleic Acids Research 19(18):5081, Oxford University Press, United Kingdom (Sep. 1991).

Bellec, J., et al., "CFTR Inactivation by Lentiviral Vector-mediated RNA Interference and CRISPR-Cas9 Genome Editing in Human Airway Epithelial Cells," Current Gene Therapy 15(5):447-459, Bentham Science Publishers, United Arab Emirates (2015).

Bermingham, N.A., et al., "Math1: an Essential Gene for the Generation of Inner Ear Hair Cells," Science 284(5421):1837-1841, American Association for the Advancement of Science, United States (Jun. 1999).

Boshart, M., et al., "A Very Strong Enhancer Is Located Upstream of an Immediate Early Gene of Human Cytomegalovirus," Cell 41(2):521-530, Cell Press, United States (Jun. 1985).

Bourlais, C.L., et al., "Ophthalmic Drug Delivery Systems-Recent Advances," Progress in Retinal and Eye Research 17(1):33-58, Pergamon Press, United Kingdom (Jan. 1998).

Budenz, C.L., et al., "Differential Effects of AAV.BDNF and AAV. Ntf3 in the Deafened Adult Guinea Pig Ear," Scientific Reports 5:8619, Nature Publishing Group, United Kingdom (Mar. 2015).

Chatterjee, P., et al., "Otoferlin Deficiency in Zebrafish Results in Defects in Balance and Hearing: Rescue of the Balance and Hearing Phenotype With Full-length and Truncated Forms of Mouse Otoferlin," Molecular and Cellular Biology 35(6):1043-1054, American Society for Microbiology, United States (Mar. 2015).

Chen, C.Y., et al., "mRNA Decay Mediated by Two Distinct AU-rich Elements From C-fos and Granulocyte-macrophage Colony-stimulating Factor Transcripts: Different Deadenylation Kinetics and Uncoupling From Translation," Molecular and Cellular Biology 15(10):5777-5788, American Society for Microbiology, United States (Oct. 1995).

Chen, J., et al., "Expression of Rat Bone Sialoprotein Promoter in Transgenic Mice," Journal of Bone and Mineral Research 11(5):654-664, American Society for Bone and Mineral Research, United States (May 1996).

Chen, Z., et al., "Inner Ear Drug Delivery via a Reciprocating Perfusion System in the Guinea Pig," Journal of Controlled Release 110(1):1-19, Elsevier Science Publishers, Netherlands (Dec. 2005).

Choi, B.Y., et al., "Identities and Frequencies of Mutations of the Otoferlin Gene (OTOF) Causing DFNB9 Deafness in Pakistan," Clinical Genetics 75(3):237-243, Copenhagen, Denmark (Mar. 2009).

Cong L., et al., "Multiplex Genome Engineering Using CRISPR/Cas Systems," Science, 339(6121):819-823, American Association for the Advancement of Science, United States (2013).

Crispo, M., et al., "Embryo Development, Fetal Growth and Postnatal Phenotype of eGFP Lambs Generated by Lentiviral Transgenesis," Transgenic Research 24(1):31-41, Kluwer Academic Publishers, Netherlands (Feb. 2015).

Dalgleish, D.G., et al., "The Characterization of Small Emulsion Droplets Made From Milk Proteins and Triglyceride Oil," Colloids and Surfaces 123-124: 145-153, Elsevier, Netherlands (1997).

De Campo, L., et al., "Five-Component Food-Grade Microemulsions: Structural Characterizations by SANS," Journal of Colloid and Interface Science 274(1):251-267, Academic Press, United States (Jun. 2004).

De Felipe, P and Izquierdo, M., "Tricistronic and Tetracistronic Retroviral Vectors for Gene Transfer," Human Gene Therapy 11(13):1921-1931, Mary Ann Liebert Inc., United States (Sep. 2000).

De Felipe, P., et al., "Use of the 2A Sequence From Foot-and-mouth Disease Virus in the Generation of Retroviral Vectors for Gene Therapy," Gene Therapy 6(2):198-208, Nature Publishing Group, United Kingdom (Feb. 1999).

(56) References Cited

OTHER PUBLICATIONS

De Fougerolles, A.R., "Delivery Vehicles for Small Interfering RNA in Vivo," Human Gene Therapy 19(2):125-132, Mary Ann Liebert Inc., United States (2008).
Di Domenico, M., et al., "Towards Gene Therapy for Deafness," Journal of Cellular Physiology 226(10):2494-2499, Wiley-Liss, United States (Oct. 2011).
Dmitriev, I., et al., "An Adenovirus Vector With Genetically Modified Fibers Demonstrates Expanded Tropism via Utilization of a Coxsackievirus and Adenovirus Receptor-Independent Cell Entry Mechanism," Journal of Virology 72(12):9706-9713, American Society For Microbiology, United States (Dec. 1998).
Duan, D., et al., "Expanding AAV Packaging Capacity With Trans-splicing or Overlapping Vectors: a Quantitative Comparison," Molecular Therapy 4(4):383-391, Cell Press, United States (Oct. 2001).
Duman, D., et al., "Screening of 38 Genes Identifies Mutations in 62% of Families With Nonsyndromic Deafness in Turkey," Genetic Testing and Molecular Biomarkers 15(1-2):29-33, Mary Ann Liebert Inc., United States (Jan.-Feb. 2011).
Duncker, S.V., et al., "Otoferlin Couples to Clathrin-mediated Endocytosis in Mature Cochlear Inner Hair Cells," The Journal of neuroscience 33(22):9508-9519, Society for Neuroscience, United States (May 2013).
Engel, J., et al., "Two Classes of Outer Hair Cells Along the Tonotopic Axis of the Cochlea," Neuroscience 143(3):837-849, Elsevier Science, United States (Dec. 2006).
Evans, G. A. and Lewis, K. A., "Physical Mapping of Complex Genomes by Cosmid Multiplex Analysis," Proceedings of the National Academy of Sciences of the United States of America 86(13):5030-5034, National Academy of Sciences, United States (Jul. 1989).
Fisher, K.J., et al., "Transduction With Recombinant Adeno-associated Virus for Gene Therapy Is Limited by Leading-strand Synthesis," Journal of Virology 70(1):520-532, American Society For Microbiology, United States (Jan. 1996).
Furler, S., et al., "Recombinant AAV Vectors Containing the Foot and Mouth Disease Virus 2A Sequence Confer Efficient Bicistronic Gene Expression in Cultured Cells and Rat Substantia Nigra Neurons," Gene Therapy 8(11):864-873, Nature Publishing Group, United Kingdom (Jun. 2001).
Ghosh, A., et al., "A Hybrid Vector System Expands Adeno-Associated Viral Vector Packaging Capacity in a Transgene-Independent Manner," Molecular Therapy 16(1):124-130, Cell Press, United States (Jan. 2008).
Ghosh, A., et al., "Efficient Transgene Reconstitution with Hybrid Dual AAV Vectors Carrying the Minimized Bridging Sequences," Human Gene Therapy 22(1):77-83, Mary Ann Liebert Inc., United States (Jan. 2011).
Gossen, M. and Bujard, H., "Tight Control of Gene Expression in Mammalian Cells by Tetracycline-Responsive Promoters," Proceedings of the National Academy of Sciences of the United States of America 89(12):5547-5551, National Academy of Sciences, United States (Jun. 1992).
Gossen, M., "Transcriptional Activation by Tetracyclines in Mammalian Cells," Science 268: 1766-1769, American Association for the Advancement of Science, United States (Jun. 1995).
Halpin, C., et al., "Self-Processing 2A-Polyproteins—a System for Co-ordinate Expression of Multiple Proteins in Transgenic Plants," Plant Journal for Cell and Molecular Biology 17(4):453-459, Blackwell Scientific Publishers and BIOS Scientific Publishers in association with the Society for Experimental Biology, United Kingdom (Feb. 1999).
Hansal, S. A., et al., "Induction of Antigen-Specific Hyporesponsiveness by Transplantation of Hemopoietic Cells Containing an MHC Class I Transgene Regulated by a Lymphocyte-Specific Promoter," Journal of Immunology 161(3):1063-1068, American Association of Immunologists, United States (Aug. 1998).
Harvey, D. M. and Caskey, C. T., "Inducible Control of Gene Expression: Prospects for Gene Therapy," Current Opinion in Chemical Biology 2(4):512-518, Elsevier, United Kingdom (Aug. 1998).
Heidel, J.D., et al., "Administration in Non-Human Primates of Escalating Intravenous Doses of Targeted Nanoparticles Containing Ribonucleotide Reductase Subunit M2 siRNA," Proceedings of the National Academy of Sciences USA 104(14):5715-5721, National Academy of Sciences, United States (2007).
Heidrych, P., et al., "Otoferlin Interacts with Myosin VI: Implications for Maintenance of the Basolateral Synaptic Structure of the Inner Hair Cell," Human Molecular Genetics 18(15):2779-2790, IRL Press at Oxford University Press, United Kingdom (Aug. 2009).
Heidrych, P., et al., "Rab8b GTPase, a Protein Transport Regulator, is an Interacting Partner of Otoferlin, Defective in a Human Autosomal Recessive Deafness Form," Human Molecular Genetics 17(23):3814-3821, IRL Press at Oxford University Press, United Kingdom (Dec. 2008).
Hellen, C. U. and Sarnow, P., "Internal Ribosome Entry Sites in Eukaryotic mRNA Molecules," Genes & Development 15(13):1593-1612, Cold Spring Harbor Laboratory Press, United States (Jul. 2001).
Hu-Lieskovan, S. et al., "Sequence-Specific Knockdown of EWS-FL11 by Targeted, Non-viral Delivery of Small Interfering RNA Inhibits Tumor Growth in a Murine Model of Metastatic Ewing's Sarcoma", Cancer Research 65: 8984-8982, American Association for Cancer Research, United States (Oct. 2005).
Husseman, J. and Raphael, Y., "Gene Therapy in the Inner Ear Using Adenovirus Vectors," Adv. Otorhinolaryngol. 66:37-51, Karger, Switzerland (2009).
Ikeno, M., et al., "Construction of YAC-based Mammalian Artificial Chromosomes," Nature Biotechnology 16(5):431-439, Nature America Publishing, United States (May 1998).
Non-Final Office Action, dated Dec. 14, 2021, in U.S. Appl. No. 17/378,606, filed Jul. 16, 2021.
Non-Final Office Action, dated Jun. 14, 2022, in U.S. Appl. No. 17/378,606, filed Jul. 16, 2021.
Iwasa, Y., et al., "OTOF Mutation Screening in Japanese Severe to Profound Recessive Hearing Loss Patients," BMC Medical Genetics 14:95, BioMed Central, United Kingdom (Sep. 2013).
Izumikawa, M., et al., "Response of the Flat Cochlear Epithelium to Forced Expression of Atoh1," 240(1-2):52-56, Hearing Research, Netherlands (Jun. 2008).
Jing, Z., et al., "Disruption of the Presynaptic Cytomatrix Protein Bassoon Degrades Ribbon Anchorage, Multiquantal Release, and Sound Encoding at the Hair Cell Afferent Synapse," The Journal of Neuroscience 33(10):4456-4467, Society for Neuroscience, United States (Mar. 2013).
Johnson, C.P. and Chapman, E.R., "Otoferlin Is a Calcium Sensor That Directly Regulates SNARE-mediated Membrane Fusion," The Journal of Cell Biology 191(1):187-197, Rockefeller University Press, United States (Oct. 2010).
Jung, S., et al., "Disruption of Adaptor Protein 2mu (AP-2mu) in Cochlear Hair Cells Impairs Vesicle Reloading of Synaptic Release Sites and Hearing," The EMBO Journal 34(21):2686-2702, Wiley Blackwell, United Kingdom (Nov. 2015).
Katoh, M., et al., "Construction of a Novel Human Artificial Chromosome Vector for Gene Delivery," Biochemical and Biophysical Research Communications 321(2):280-290, Elsevier, United States (Aug. 2004).
Kawamoto, K., et al., "Math1 Gene Transfer Generates New Cochlear Hair Cells in Mature Guinea Pigs in Vivo," The Journal of Neuroscience 23(11):4395-4400, Society for Neuroscience, United States (Jun. 2003).
Kazuki, Y. and Oshimura, M., "Human Artificial Chromosomes for Gene Delivery and the Development of Animal Models," Molecular Therapy 19(9):1591-1601, Cell Press, United States (Sep. 2011).
Kazuki, Y., et al., "Refined Human Artificial Chromosome Vectors for Gene Therapy and Animal Transgenesis," Gene Therapy 18(4):384-393, Nature Publishing Group, United Kingdom (Apr. 2011).

(56) References Cited

OTHER PUBLICATIONS

Klump, H., et al., "Retroviral Vector-mediated Expression of HoxB4 in Hematopoietic Cells Using a Novel Coexpression Strategy," Gene Therapy 8(10):811-817, Nature Publishing Group, United Kingdom (May 2001).
Kouprina, N., et al., "Human Artificial Chromosome-based Gene Delivery Vectors for Biomedicine and Biotechnology," Expert Opinion on Drug Delivery 11(4):517-535, Informa Healthcare, United Kingdom (Apr. 2014).
Kral, A. and O'Donoghue, G.M., "Profound Deafness in Childhood," The New England Journal of Medicine 363(15):1438-1450, Massachusetts Medical Society, United States (Oct. 2010).
Lai, Y., et al., "Efficient in Vivo Gene Expression by Trans-splicing Adeno-associated Viral Vectors," Nature Biotechnology 23(11):1435-1439, Nature America Publishing, United States (Nov. 2005).
Landegger, L.D., et al., "A Synthetic AAV Vector Enables Safe and Efficient Gene Transfer to the Mammalian Inner Ear," Nature Biotechnology 35(3):280-284, Nature America Publishing, United States (Mar. 2017).
Levitt, N., et al., "Definition of an Efficient Synthetic Poly(A) Site," Genes & Development 3(7):1019-1025, Cold Spring Harbor Laboratory Press, United States (Jul. 1989).
Li, L., et al., "Production and Characterization of Novel Recombinant Adeno-associated Virus Replicative-form Genomes: A Eukaryotic Source of DNA for Gene Transfer," PLoS One 8(8):e69879, Public Library of Science, United States (Aug. 2013).
Longo-Guess, C., et al., "A Missense Mutation in the Conserved C2B Domain of Otoferlin Causes Deafness in a New Mouse Model of DFNB9," Hearing Research 234(1-2):21-28, Elsevier/North-Holland Biomedical Press, Netherlands (Dec. 2007).
Lostal, W., et al., "Efficient Recovery of Dysferlin Deficiency by Dual Adeno-Associated Vector-Mediated Gene Transfer," Human Molecular Genetics 19(10):1897-1907, IRL Press at Oxford University Press, United Kingdom (May 2010).
Magari, S.R., et al., "Pharmacologic Control of a Humanized Gene Therapy System Implanted Into Nude Mice," The Journal of Clinical Investigation 100(11):2865-2872, American Society for Clinical Investigation, United States (Dec. 1997).
Maier, P., et al., "Retroviral Vectors for Gene Therapy," Future Microbiology 5(10):1507-1523, Future Medicine, United Kingdom (Oct. 2010).
Marlin, S., et al., "Temperature-sensitive Auditory Neuropathy Associated With an Otoferlin Mutation: Deafening Fever!" Biochemical and Biophysical Research Communications 394(3):737-742, Elsevier, United States (Apr. 2010).
Matrai, J., et al., "Recent Advances in Lentiviral Vector Development and Applications," Molecular Therapy 18(3):477-490, Cell Press, United States (Mar. 2010).
Mattion, N.M., et al., "Foot-and-mouth Disease Virus 2a Protease Mediates Cleavage in Attenuated Sabin 3 Poliovirus Vectors Engineered for Delivery of Foreign Antigens," Journal of Virology 70(11):8124-8127, American Society For Microbiology, United States (Nov. 1996).
Menchaca, A. and Rubianes, E., "New Treatments Associated With Timed Artificial Insemination in Small Ruminants," Reproduction, Fertility, and Development 16(4):403-413, Commonwealth Scientific and Industrial Research Organisation, Australia (2004).
Menoret, et al., "Advanced protocols for Animal Transgenesis," An ISTT Manual, Heidelberg: Springer, pp. 117-136, Germany (2011).
Migliosi, V., et al., "Q829X, A Novel Mutation in the Gene Encoding Otoferlin (OTOF), Is Frequently Found in Spanish Patients With Prelingual Non-syndromic Hearing Loss," Journal of Medical Genetics 39(7):502-506, British Medical Association, United Kingdom (Jul. 2002).
Milone, M.C., et al., "Chimeric Receptors Containing CD137 Signal Transduction Domains Mediate Enhanced Survival of T Cells and Increased Antileukemic Efficacy in Vivo," Molecular Therapy 17(8):1453-1464, Cell Press, United States (Aug. 2009).
Mirghomizadeh, F., et al., "Substitutions in the Conserved C2C Domain of Otoferlin Cause DFNB9, a Form of Nonsyndromic Autosomal Recessive Deafness," Neurobiology of Disease 10(2):157-164, Academic Press, United States (Jul. 2002).
Moser, T and Beutner, D., "Kinetics of Exocytosis and Endocytosis at the Cochlear Inner Hair Cell Afferent Synapse of the Mouse," Proceedings of the National Academy of Sciences of the United States of America 97(2):883-888, National Academy of Sciences, United States (Jan. 2000).
Murray, A.W. and Szostak, J.W., "Construction of Artificial Chromosomes in Yeast," Nature 305(5931):189-193, Nature Publishing Group, United Kingdom (Sep. 1983).
Neef, A., et al., "Probing the Mechanism of Exocytosis at the Hair Cell Ribbon Synapse," The Journal of Neuroscience 27(47):12933-12944, Society for Neuroscience, United States (Nov. 2007).
No, D., et al., "Ecdysone-inducible Gene Expression in Mammalian Cells and Transgenic Mice," Proceedings of the National Academy of Sciences of the United States of America 93(8):3346-3351, National Academy of Sciences, United States (Apr. 1996).
Ohtsuka, E., et al., "An Alternative Approach to Deoxyoligonucleotides as Hybridization Probes by Insertion of Deoxyinosine at Ambiguous Codon Positions," The Journal of Biological Chemistry 260(5):2605-2608, Elsevier Inc., United States (Mar. 1985).
Orkin, S.H., et al., "Thalassemia Due to a Mutation in the Cleavage-polyadenylation Signal of the Human Beta-globin Gene," The EMBO Journal 4(2):453-456, Wiley Blackwell, United Kingdom (Feb. 1985).
Padmanarayana, M., et al., "Characterization of the Lipid Binding Properties of Otoferlin Reveals Specific Interactions Between PI(4,5)P2 and the C2C and C2F Domains," Biochemistry 53(30):5023-5033, American Chemical Society, United States (Aug. 2014).
Pangrsic, T., et al., "Hearing Requires Otoferlin-dependent Efficient Replenishment of Synaptic Vesicles in Hair Cells," Nature Neuroscience 13(7):869-876, Nature Publishing Group, United States (Jul. 2010).
Pangrsic, T., et al., "Otoferlin: A Multi-C2 Domain Protein Essential for Hearing," Trends in Neurosciences 35(11):671-680, Elsevier Applied Science Publishing, United Kingdom (Nov. 2012).
Pelletier, J., et al., "Cap-Independent Translation of Poliovirus mRNA is Conferred by Sequence Elements within the 5' Noncoding Region," Molecular and Cellular Biology 8(3):1103-1112, American Society for Microbiology, United States (Mar. 1988).
Pezzoli, D., et al., "Lipid-Based Nanoparticles as Nonviral Gene Delivery Vectors," Methods in Molecular Biology 1025:269-279, Humana Press, United States (2013).
Piccioli, P., et al., "Neuroantibodies: Ectopic Expression of a Recombinant Anti-substance P Antibody in the Central Nervous System of Transgenic Mice," Neuron 15(2):373-384, Cell Press, United States (Aug. 1995).
Piccioli, P., et al., "Neuroantibodies: Molecular Cloning of a Monoclonal Antibody Against Substance P for Expression in the Central Nervous System," Proceedings of the National Academy of Sciences of the United States of America 88(13):5611-5615, National Academy of Sciences, United States (Jul. 1991).
Praetorius, M., et al., "Adenovector-Mediated Hair Cell Regeneration is Affected by Promoter Type," Acta Otolaryngol. 130(2):215-222, Taylor & Francis, United States (Feb. 2010).
Proudfoot, N.J., et al., "Integrating mRNA Processing with Transcription," Cell 108(4):501-512, Cell Press, United States (Feb. 2002).
Pryadkina, M., et al., "A comparison of AAV Strategies Distinguishes Overlapping Vectors for Efficient Systemic Delivery of the 6.2 kb Dysferlin Coding Sequence," Molecular Therapy. Methods & Clinical Development 2:15009, Cell Press, United States (Mar. 2015).
Reich, S.J., et al., "Efficient Trans-Splicing in the Retina Expands the Utility of Adeno-Associated Virus as a Vector for Gene Therapy," Human Gene Therapy 14(1):37-44, M.A. Liebert, United States (Jan. 2003).
Reisinger, E., et al., "Probing the Functional Equivalence of Otoferlin and Synaptotagmin 1 in Exocytosis," The Journal of Neuroscience 31(13):4886-4895, Society for Neuroscience, United States (Mar. 2011).

(56) References Cited

OTHER PUBLICATIONS

Ren, X., et al., "Human Artificial Chromosome Vectors Meet Stem Cells: New Prospects for Gene Delivery," Stem Cell Reviews 2(1):43-50, Humana Press, United States (2006).
Rodriguez-Ballesteros, M., et al., "A Multicenter Study on the Prevalence and Spectrum of Mutations in the Otoferlin Gene (OTOF) in Subjects with Nonsyndromic Hearing Impairment and Auditory Neuropathy," Human Mutation 29(6):823-831, Wiley-Liss, United States (Jun. 2008).
Rodriguez-Ballesteros, M., et al., "Auditory Neuropathy in Patients Carrying Mutations in the Otoferlin Gene (OTOF)," Human Mutation 22(6):451-456, Wiley-Liss, United States (Dec. 2003).
Rossolini, G.M., et al., "Use of Deoxyinosine-Containing Primers vs Degenerate Primers for Polymerase Chain Reaction Based on Ambiguous Sequence Information," Molecular and Cellular Probes 8(2):91-98, Academic Press, United Kingdom (Apr. 1994).
Roux, I., et al., "Otoferlin, Defective in a Human Deafness Form, Is Essential for Exocytosis at the Auditory Ribbon Synapse," Cell 127(2):277-289, Cell Press, United States (Oct. 2006).
Rozema, D.B., et al., "Dynamic Polyconjugates for Targeted in Vivo Delivery of siRNA to Hepatocytes," Proceedings of the National Academy of Sciences USA 104(32): 12982-12987, National Academy of Sciences, United States (2007).
Ryan, M.D., et al., "Foot-and-Mouth Disease Virus 2A Oligopeptide Mediated Cleavage of an Artificial Polyprotein," EMBO 13(4):928-933, Wiley Blackwell, United Kingdom (Feb. 1994).
Schek, N., et al., "Definition of the Upstream Efficiency Element of the Simian Virus 40 Late Polyadenylation Signal by Using in Vitro Analyses," Molecular and Cellular Biology 12(12):5386-5393, American Society for Microbiology, United States (Dec. 1992).
Shu, Y., et al., "Identification of Adeno-Associated Viral Vectors That Target Neonatal and Adult Mammalian Inner Ear Cell Subtypes," Human Gene Therapy 27(9):687-699, Mary Ann Liebert, Inc., United States (Sep. 2016).
Smith, R.J.H., et al., "Sensorineural Hearing Loss in Children," Lancet 365(9462):879-890, Elsevier, United Kingdom (Mar. 2005).
Staecker, H., et al., "Vestibular Hair Cell Regeneration and Restoration of Balance Function Induced by Math1 Gene Transfer," Otol. Neurotol. 28(2):223-231, Lippincott Williams & Wilkins, United States (Feb. 2007).
Stein, G.S., et al., "The Osteocalcin Gene: A Model for Multiple Parameters of Skeletal-Specific Transcriptional Control," Molecular Biology Reports 24(3):185-196, Dordrecht, Netherlands (Aug. 1997).
Stiller, M., et al., "Direct Multiplex Sequencing (DMPS)—A Novel Method for Targeted High-Throughput Sequencing of Ancient and Highly Degraded DNA," Genome Research 19(10):1843-1848, Cold Spring Harbor Laboratory Press, United States (Oct. 2009).
Strenzke, N., et al., "Hair Cell Synaptic Dysfunction, Auditory Fatigue and Thermal Sensitivity in Otoferlin I1e515Thr Mutants," The EMBO Journal 35(23):2519-2535, Wiley Blackwell, United Kingdom (Dec. 2016).
Suzuki, J., et al., "Cochlear Gene Therapy with Ancestral AAV in Adult Mice: Complete Transduction of Inner Hair Cells Without Cochlear Dysfunction," Scientific Reports 7:45524, Nature Publishing Group, United Kingdom (Apr. 2017).
Szymanski, P., et al., "Development and Validation of a Robust and Versatile One-Plasmid Regulated Gene Expression System," Molecular Therapy 15(7):1340-1347, Cambridge, MA : Cell Press, United States (Jul. 2007).
Tandon, V., et al., "Microfabricated Infuse-Withdraw Micropump Component for an Integrated Inner-Ear Drug-Delivery Platform," Biomedical Microdevices 17(2):37 Springer, United States (Apr. 2015).
Tandon, V., et al., "Microfabricated Reciprocating Micropump for Intracochlear Drug Delivery with Integrated Drug/Fluid Storage and Electronically Controlled Dosing," Lab Chip 16(5):829-846, Royal Society of Chemistry, United Kingdom (Mar. 2016).
Tereshchenko, J., et al., "Pharmacologically Controlled, Discontinuous GDNF Gene Therapy Restores Motor Function in a Rat Model of Parkinson's Disease," Neurobiol Dis 65:35-42, Elsevier, Netherlands (May 2014).
Thein, S.L., et al., "The Polyadenylation Site Mutation in the Alpha-Globin Gene Cluster," Blood 71(2):313-319, Elsevier, United States (Feb. 1988).
Trapani, I., et al., "Effective Delivery of Large Genes to the Retina by Dual AAV Vectors," EMBO Molecular Medicine 6(2):194-211, Wiley-Blackwell, United Kingdom (Feb. 2014).
Varga, R., et al., "OTOF Mutations Revealed by Genetic Analysis of Hearing Loss Families Including A Potential Temperature Sensitive Auditory Neuropathy Allele," Journal of Medical Genetics 43(7):576-581, British Medical Association, United Kingdom (Jul. 2006).
Wahl, G.M., et al., "Cosmid Vectors for Rapid Genomic Walking, Restriction Mapping, and Gene Transfer," Proceedings of the National Academy of Sciences of the United States of America 84(8):2160-2164, National Academy of Sciences, United States (Apr. 1987).
Wang, D.Y., et al., "Screening Mutations of OTOF Gene in Chinese Patients with Auditory Neuropathy, Including A Familial Case of Temperature-Sensitive Auditory Neuropathy," BMC Medical Genetics 11:79, BioMed Central, United Kingdom (May 2010).
Wang, J., et al., "Inhibition of the C-jun N-terminal Kinase-mediated Mitochondrial Cell Death Pathway Restores Auditory Function in Sound-exposed Animals," Molecular Pharmacology 71(3):654-666, American Society for Pharmacology and Experimental Therapeutics, United States (Mar. 2007).
Wang, Y., et al., "Ligand-Inducible and Liver-Specific Target Gene Expression in Transgenic Mice," Nature Biotechnology 15(3):239-243, Nature America Publishing, United States (Mar. 1997).
Wang, Y., et al., "Positive and Negative Regulation of Gene Expression in Eukaryotic Cells with An Inducible Transcriptional Regulator," Gene Therapy 4(5):432-441, Nature Publishing Group, United Kingdom (May 1997).
Wanisch, K., et al., "Integration-Deficient Lentiviral Vectors: A Slow Coming of Age," Molecular Therapy 17(8):1316-1332, Cell Press, United States (Aug. 2009).
Woychik, R.P., et al., "Requirement for the 3' Flanking Region of the Bovine Growth Hormone Gene for Accurate Polyadenylylation," Proceedings of the National Academy of Sciences of the United States of America 81(13):3944-3948, National Academy of Sciences, United States (Jul. 1984).
Xiao, W., et al., "Gene Therapy Vectors Based on Adeno-Associated Virus Type 1," Journal of Virology 73(5):3994-4003, American Society for Microbiology, United States (1999).
Yan, Z., et al., "Trans-Splicing Vectors Expand the Utility of Adeno-Associated Virus for Gene Therapy," Proceedings of the National Academy of Sciences of the United States of America 97(12):6716-6721, National Academy of Sciences, United States (Jun. 2000).
Yasunaga, S., et al., "OTOF Encodes Multiple Long and Short Isoforms: Genetic Evidence That the Long Ones Underlie Recessive Deafness DFNB9," American Journal of Human Genetics 67(3):591-600, Cell Press, United States (Sep. 2000).
Yildirim-Baylan, M., et al., "Evidence for Genotype-Phenotype Correlation for OTOF Mutations," International Journal of Pediatric Otorhinolaryngology 78(6):950-953, Elsevier, Netherlands (Jun. 2014).
Zhang, Q.J., et al., "High Frequency of OTOF Mutations in Chinese Infants With Congenital Auditory Neuropathy Spectrum Disorder," Clinical Genetics 90(3): 238-246, Wiley Online Library, Denmark (2016).
Herdewijn, P., ed., "Oligonucleotide synthesis: methods and applications," Methods in in Molecular Biology 288, Humana Press, United States (2005).
O'Donnell, P. B., and McGinity, J. W., "Preparation of microspheres by the solvent evaporation technique," Adv. Drug Delivery Rev. 28(1):25-42, Elsevier, Netherlands (1997).
Poulin, K. L., et al., "Use of Cre/loxP recombination to swap cell binding motifs on the adenoviral capsid protein IX," J. Virol. 8:10074-10086, American Society for Microbiology, United States (2010).

(56) References Cited

OTHER PUBLICATIONS

Vilette, D., et al., "Establishment of astrocyte cell lines from sheep genetically susceptible to scrapie," In Vitro Cellular & Developmental Biology 36(1):45-49, Springer, United States (2000).
Ahmad, S. et al., "Restoration of connexin26 protein level in the cochlea completely rescues hearing in a mouse model of human connexin30-linked deafness," Proc. Natl. Acad. Sci., 104(4):1337-1341, National Academy of Sciences, United States (2007).
Chamberlain, K., et al., "Expressing Transgenes That Exceed the Packaging Capacity of Adeno-Associated Virus Capsids," Human Gene Therapy Methods 27(1):1-12, Mary Ann Liebert, Inc., United States (2016).
Holt, J., et al., "Split Otoferlins Reunited," EMBO Mol Med 11:1-3, European Molecular Biology Organization, Germany (2018).
An, W., et al., "Engineering FKBP-Based Destabilizing Domains to Build Sophisticated Protein Regulation Systems," PLoS One 10(12):e0145783, Public Library of Science, United States (Dec. 2015).
International Search Report and Written Opinion for International Application No. PCT/US2021/018919, European Patent Office, Netherlands, dated Jun. 17, 2021.
GenBank, "Danio rerio strain Tuebingen chromosome 20, GRCz11 Primary Assembly," Accession No. NC_007131, accessed at https://www.ncbi.nlm.nih.gov/nuccore/NC_007131, accessed on Aug. 3, 2022, 2 pages.
GenBank, "Macaca mulatta isolate 17573 chromosome 13, Mmul_8.0.1, whole genome shotgun sequence," Accession No. NC_027905, accessed at https://www.ncbi.nlm.nih.gov/nuccore/NC_027905.1?report=genbank, accessed on Aug. 3, 2022, 2 pages.
GenBank, "Canis lupus familiaris isolate Tasha breed boxer chromosome 17, alternate assembly Dog10K_Boxer_Tasha, whole genome shotgun sequence," Accession No. NC_006599, accessed at https://www.ncbi.nlm.nih.gov/nuccore/NC_006599, accessed on Aug. 3, 2022, 2 pages.
GenBank, "Pan troglodytes isolate Yerkes chimp pedigree #C0471 (Clint) chromosome 2A, Pan_tro 3.0, whole genome shotgun sequence," Accession No. NC_006469, accessed at https://www.ncbi.nlm.nih.gov/nuccore/NC_006469.4?report=genbank, accessed on Aug. 3, 2022, 3 pages.
Gilham, D.E., et al., "Cytokine stimulation and the choice of promoter are critical factors for the efficient transduction of mouse T cells with HIV-1 vectors," J. Gene. Med. 12(2):129-136, Wiley, United States (2010).
Hioki, H., et al., "Efficient gene transduction of neurons by lentivirus with enhanced neuron-specific promoters," Gene Ther. 14:872-882, Nature Portfolio, Germany (2007).
Kuroda, H., et al., "A comparative analysis of constitutive and cell-specific promoters in the adult mouse hippocampus using lentivirus vector-mediated gene transfer," J. Gene. Med. 10:1163-1175, Wiley, United States (2008).
Wang, B., et al., "Construction and analysis of compact muscle-specific promoters for AAV vectors," Gene. Ther. 15:1489-1499, Nature Portfolio, Germany (2008).
Katwal, A.B., et al., "Adeno-associated virus serotype 9 efficiently targets ischemic skeletal muscle following systemic delivery," Gene Ther. 20(9):930-938, Nature Portfolio, Germany (2013).
Paterna, J.C., et al., "Influence of promoter and WHV posttranscriptional regulatory element on AAV-mediated transgene expression in the rat brain," Gene. Ther. 7(15):1304-1311, Nature Portfolio, Germany (2000).
Rastegar, M., et al., "MECP2 isoform-specific vectors with regulated expression for Rett syndrome gene therapy," PLOS One 4:e6810, PLOS, United States (2009).
Xu, R., et al., "Quantitative comparison of expression with adeno-associated virus (AAV-2) brain-specific gene cassettes," Gene Ther. 8:1323-1332, Nature Portfolio, Germany (2001).
Brenner, M., et al., "GFAP promoter directs astrocyte-specific expression in transgenic mice," J. Neurosci. 14:1030-1037, Society for Neuroscience, United States (1994).
Lee, Y., et al., "GFAP promoter elements required for region-specific and astrocyte-specific expression," Glia 56:481-493, Wiley, United States (2008).
Chen, H., et al., "Gene transfer and expression in oligodendrocytes under the control of myelin basic protein transcriptional control region mediated by adeno-associated virus," Gene Ther. 5(1):50-58, Nature Portfolio, Germany (1998).
Sandig, V., et al., "HBV-derived promoters direct liver-specific expression of an adenovirally transduced LDL receptor gene," Gene Ther. 3:1002-1009, Nature Portfolio, Germany (1996).
Gill, D.R., et al., "Increased persistence of lung gene expression using plasmids containing the ubiquitin C or elongation factor 1alpha promoter," Gene Ther. 8(20):1539-1546, Nature Portfolio, Germany (2001).
Ikeda, Y., et al., "Gene transduction efficiency in cells of different species by HIV and EIAV vectors," Gene Ther. 9:932-938, Nature Portfolio, Germany (2002).
Qin, J.Y., et al., "Systematic comparison of constitutive promoters and the doxycycline-inducible promoter," PLOS One 5(5):e10611, PLOS, United States (2010).
Antoniou, M.N., et al., "Optimizing retroviral gene expression for effective therapies," Human Gene. Ther. 24(4):363-374, Mary Ann Liebert, Inc., United States (2013).
Husain, T., et al., "Long-term AAV vector gene and protein expression in mouse brain from a small pan-cellular promoter is similar to neural cell promoters," Gene Ther. 16:927-932, Nature Portfolio, Germany (2009).
Klein, R.L., et al., "Dose and promoter effects of adeno-associated viral vector for green fluorescent protein expression in the rat brain," Exp. Neurol. 176:66-74, Elsevier, Netherlands (2002).
GenBank, "Human beta-actin gene 5'-flanking region," Accession No. Y00474.1, accessed at https://www.ncbi.nlm.nih.gov/nuccore/Y00474.1, accessed on Aug. 3, 2022, 2 pages.
Duclert, A., et al., "An 83-nucleotide promoter of the acetylcholine receptor epsilon-subunit gene confers preferential synaptic expression in mouse muscle," PNAS 90(7):3043-3047, National Academy of Sciences, United States (1993).
GenBank, "acetylcholine receptor epsilon-subunit {promoter} [mice, DBA/2J, Genomic, 223 nt]," Accession No. S58221.1, https://www.ncbi.nlm.nih.gov/nuccore/S58221.1, accessed on Aug. 3, 2022, 1 page.
GenBank, "Mouse DNA sequence from clone DN-183N8 on chromosome 11, complete sequence," Accession No. CR933736.12, accessed at https://www.ncbi.nlm.nih.gov/nuccore/CR933736.12, accessed on Aug. 3, 2022, 44 pages.
GenBank, "pRSVNeo cloning vector for high efficiency gene transfer into mammalian cells," Accession No. M77786.1, accessed at https://www.ncbi.nlm.nih.gov/nuccore/M77786.1, accessed on Aug. 3, 2022, 2 pages.
GenBank, "*Homo sapiens* glial fibrillary acidic protein (GFAP), RefSeqGene on chromosome 17," Accession No. NG_008401, accessed at https://www.ncbi.nlm.nih.gov/nuccore/NG_008401, accessed on Aug. 3, 2022, 10 pages.
GenBank, "Human glial fibrillary acidic protein (GFAP), exon 1," Accession No. M67446.1, accessed at https://www.ncbi.nlm.nih.gov/nuccore/M67446.1, accessed on Aug. 3, 2022, 2 pages.
GenBank, "AAV expression vector pTR-UF50-BC, complete sequence," Accession No. KF926476.1, accessed at https://www.ncbi.nlm.nih.gov/nuccore/KF926476.1, accessed on Aug. 3, 2022, 3 pages.
GenBank, "Expression vector pAAV-CAG-Fluc, complete sequence," Accession No. KC152483.1, accessed at https://www.ncbi.nlm.nih.gov/nuccore/KC152483.1, accessed on Aug. 3, 2022, 4 pages.
Schambach, A., et al., "Improving transcriptional termination of self-inactivating gamma-retroviral and lentiviral vectors," Mol. Ther. 15(6):1167-1173, Cell Press, United States (2007).
Ostegaard, L.S., et al., "A shortened adeno-associated virus expression cassette for CFTR gene transfer to cystic fibrosis airway epithelia," PNAS 102(8):2952-2957, National Academy of Sciences, United States (2005).
Yew, N.S., et al., "Optimization of plasmid vectors for high-level expression in lung epithelial cells," Human Gene Ther. 8(5):575-584, Mary Ann Liebert, Inc., United States (1997).

(56) References Cited

OTHER PUBLICATIONS

Wu, Z., et al., "Optimization of self-complementary AAV vectors for liver-directed expression results in sustained correction of hemophilia B at low vector dose," Mol Ther. 16(2):280-289, Cell Press, United States (2008).

Kurachi, S., et al., "Role of intron I in expression of the human factor IX gene," J. Biol. Chem. 270(10):5276-5281, American Society for Biochemistry and Molecular Biology, United States (1995).

Huang, M.T., and Gorman, C.M., "The simian virus 40 small-t intron, present in many common expression vectors, leads to aberrant splicing," Mol. Cell. Biol. 10(4):1805-1810, American Society for Microbiology, United States (1990).

Chen, Q., et al., "An AU-rich element in the 3' untranslated region of the spinach chloroplast petD gene participates in sequence-specific RNA-protein complex formation," Mol. Cell. Biol. 15:2010-2018, American Society for Microbiology, United States (1995).

UniProtKB, "A0A2Z2CEU0_MOUSE," Accession No. KX060996, accessed at https://www.uniprot.org/uniprotkb/A0A2Z2CEU0/entry, accessed on Aug. 3, 2022, 3 pages.

Notice of Allowance, dated Aug. 3, 2022, in U.S. Appl. No. 17/378,606, filed Jul. 16, 2021.

Sacheli, R., et al., "Gene Transfer in Inner Ear Cells: A Challenging Race," *Gene Ther* 20:237-247, Nature Publishing Group, United Kingdom (2013).

Tetrais, M., et al., "Viral Transfer of Mini-Otoferlins Partially Restores the Fast Component of Exocytosis and Uncovers Ultrafast Endocytosis in Auditory Hair Cell of Otoferlin Knock-Out Mice," *J. Neurosci.* 39(18):3394-3411, Society for Neuroscience, United States (2019).

Non-Final Office Action, dated Feb. 13, 2023, in U.S. Appl. No. 17/929,647, filed Sep. 2, 2022.

Final Office Action, dated May 9, 2023, in U.S. Appl. No. 17/929,647, filed Sep. 2, 2022.

Notice of Allowance, dated May 30, 2023, in U.S. Appl. No. 17/929,647, filed Sep. 2, 2022.

\* cited by examiner

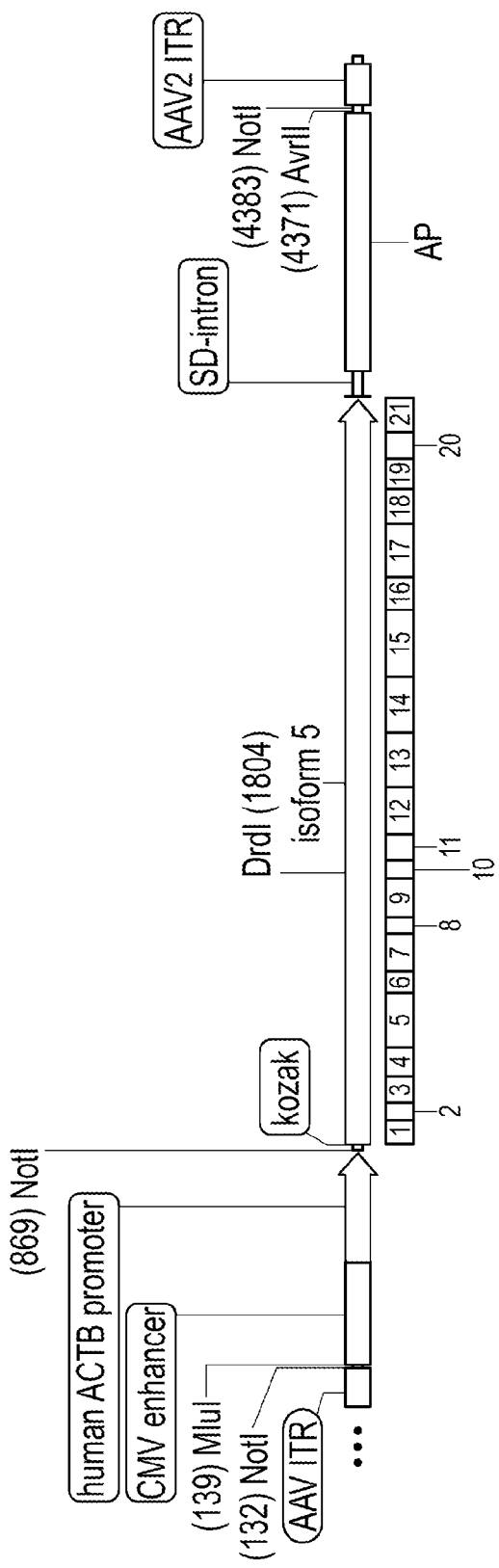
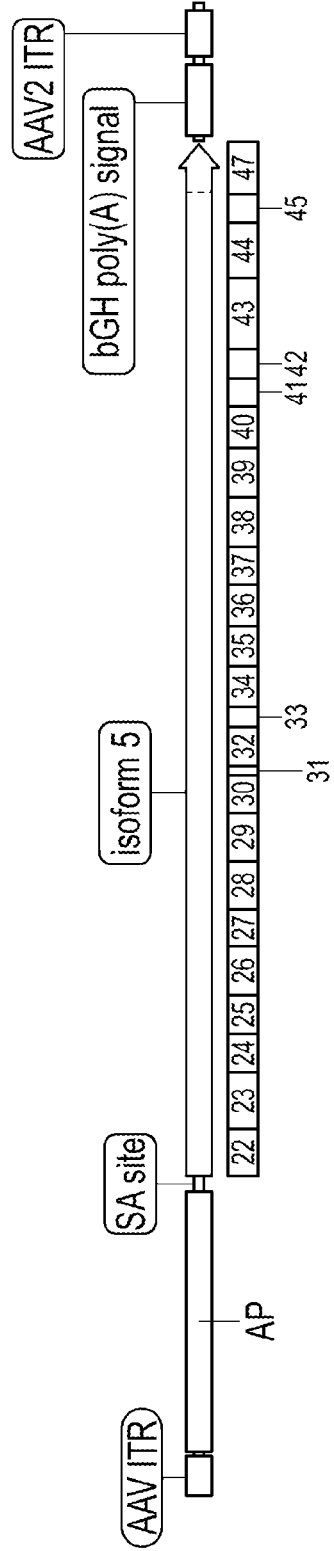
FIG. 31
FIG. 32

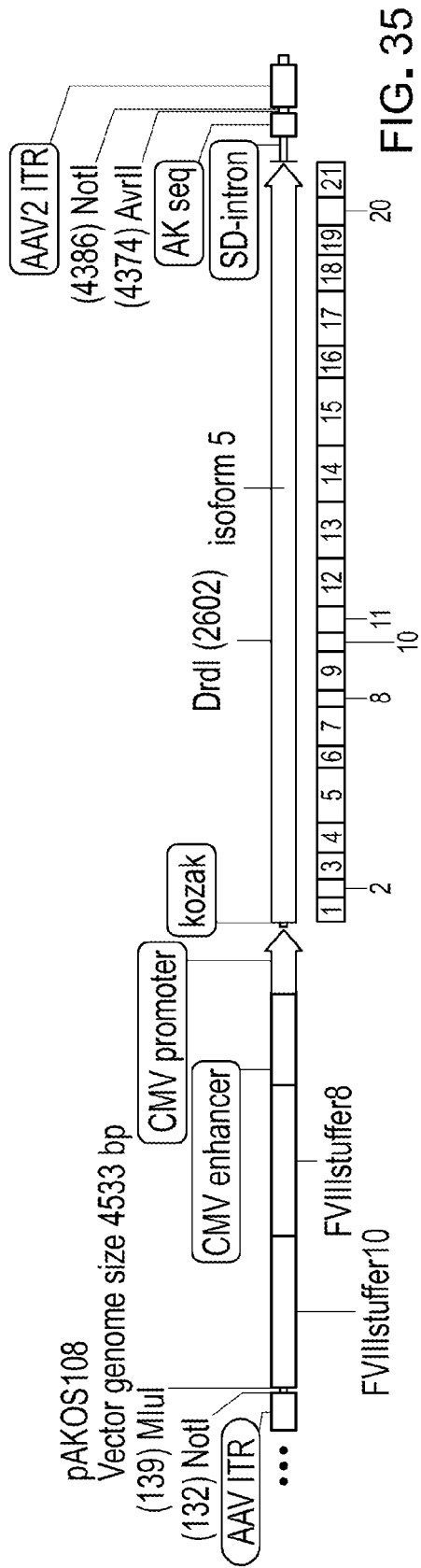
FIG. 35
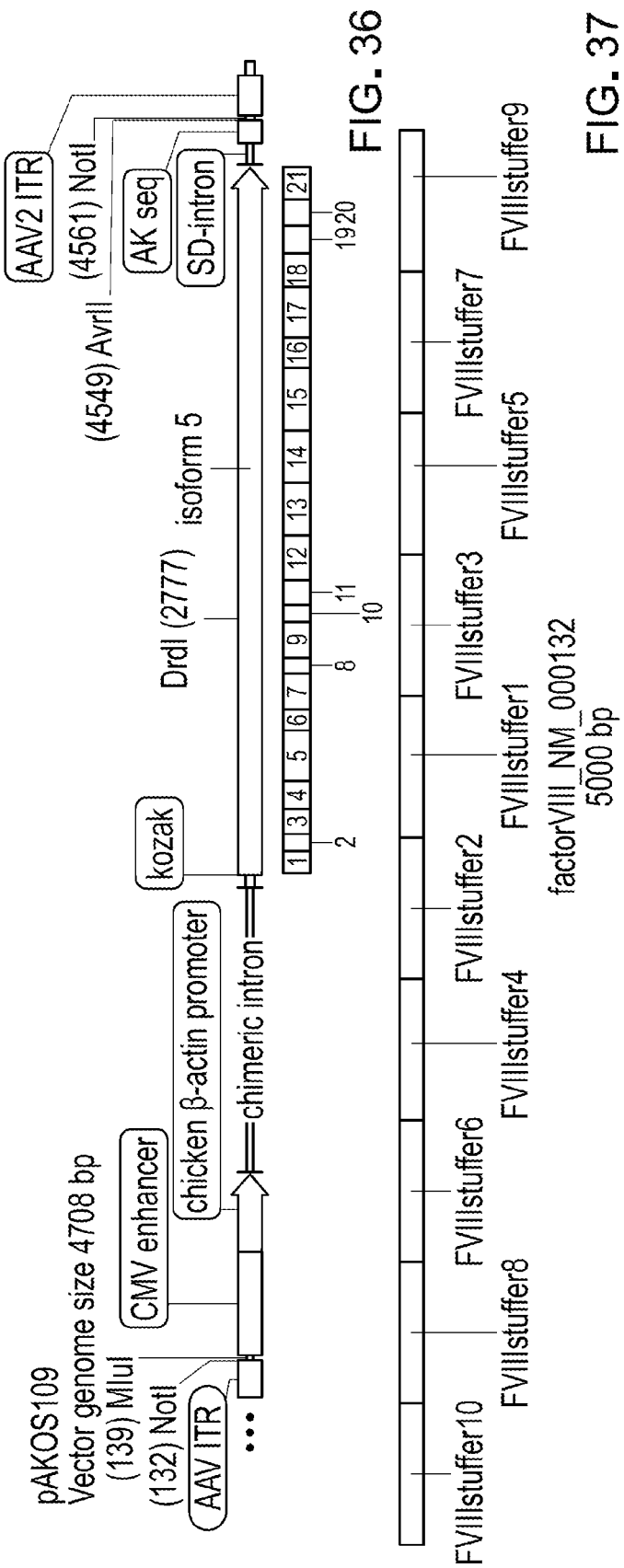
FIG. 36
FIG. 37

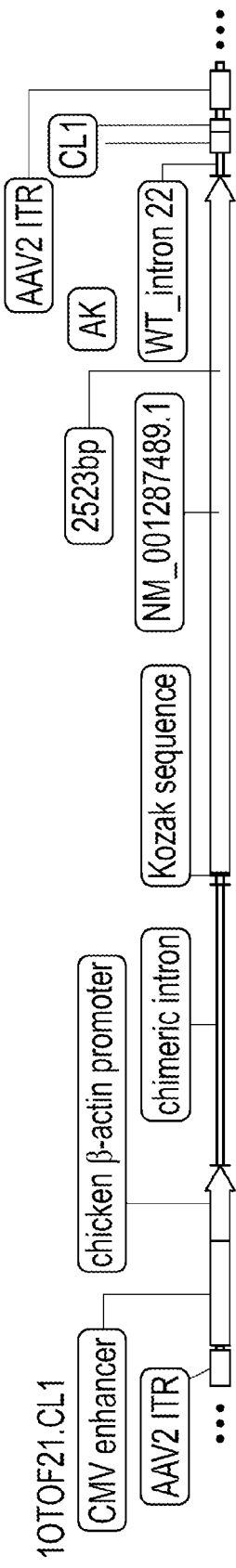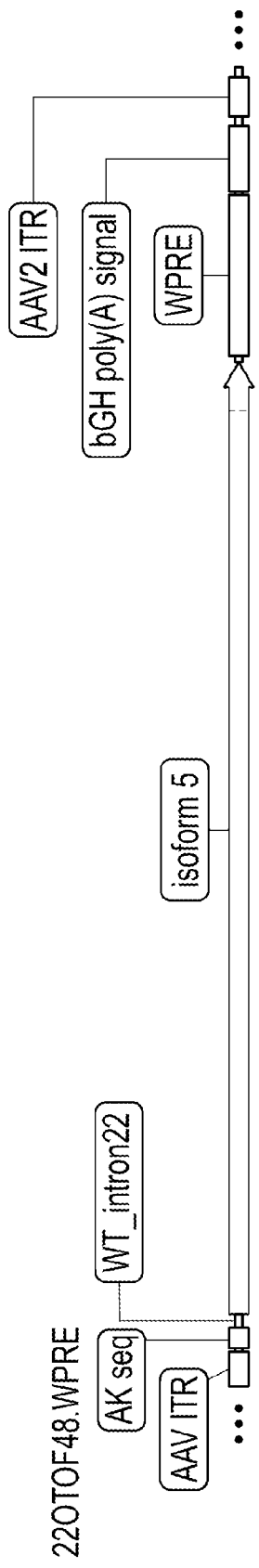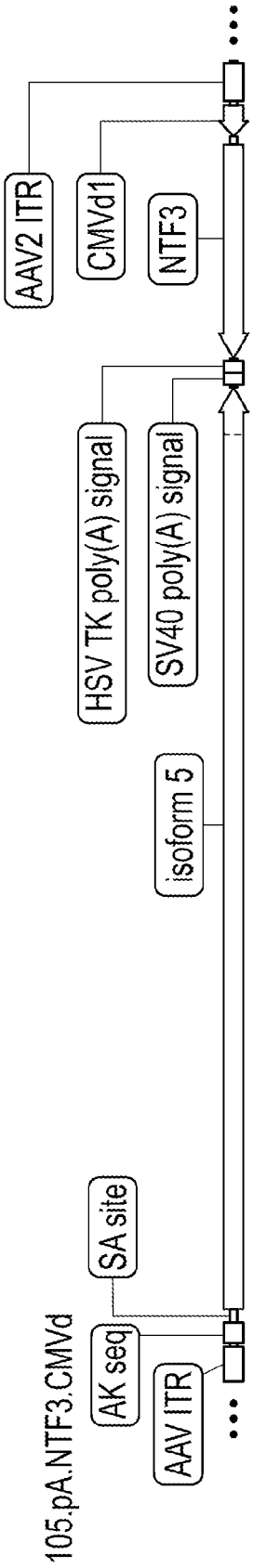
FIG. 46
FIG. 47
FIG. 48

| 400ng | 400ng | Experiment 1 | | | Experiment 2 | | | Experiment 3 | | | Final | | |
|---|---|---|---|---|---|---|---|---|---|---|---|---|---|
| Plasmid 1 | Plasmid 2 | I.I. ACTB | I.I. OTOF | Ratio | I.I. ACTB | I.I. OTOF | Ratio | I.I. ACTB | I.I. OTOF | Ratio | Average | STDEV | %CV |
| 109 | 105 | 22.29 | 0.12 | 0.005 | 18.57 | 0.39 | 0.021 | 13.41 | 0.13 | 0.010 | 0.012 | 0.01 | 67.07 |
| 109 | 105WPRE | 18.46 | 0.23 | 0.012 | 19.32 | 0.82 | 0.042 | 16.37 | 0.28 | 0.017 | 0.024 | 0.02 | 67.24 |
| 1OTOF18.CL1 | 19OTOF48 | 18.15 | 0.17 | 0.009 | 17.11 | 0.36 | 0.021 | 18.84 | 0.28 | 0.015 | 0.015 | 0.01 | 38.70 |
| 1OTOF20.CL1 | 21OTOF48.WPRE | 19.47 | 0.30 | 0.015 | 16.52 | 0.22 | 0.013 | 16.97 | 0.15 | 0.009 | 0.013 | 0.00 | 26.80 |
| 1OTOF21.CL1 | 22OTOF48.WPRE | 18.31 | 0.04 | 0.002 | 17.07 | 0.03 | 0.002 | 18.32 | 0.00 | 0.000 | 0.001 | 0.00 | N/A |
| mus_5OTOF | mus_3OTOF | 17.37 | 1.00 | 0.058 | 17.97 | 0.36 | 0.020 | 18.77 | 0.32 | 0.017 | 0.032 | 0.02 | 71.58 |
| mus_ex6_5OTOF | mus_3OTOF | 16.06 | 0.71 | 0.044 | 16.11 | 0.53 | 0.033 | 16.08 | 0.13 | 0.008 | 0.028 | 0.02 | 65.07 |
| 108 | 105 | 15.49 | 1.06 | 0.068 | 15.77 | 0.91 | 0.058 | 18.38 | 0.27 | 0.015 | 0.047 | 0.03 | 60.59 |
| CMV.fl.OTOF | CMV.fl.OTOF | 18.17 | 0.48 | 0.026 | 16.29 | 0.50 | 0.031 | 14.54 | 0.62 | 0.043 | 0.033 | 0.01 | 25.29 |
| N/A | N/A | 19.10 | 0.01 | 0.001 | 16.94 | -0.01 | -0.001 | 14.73 | -0.01 | -0.001 | 0.000 | 0.00 | N/A |

FIG. 50

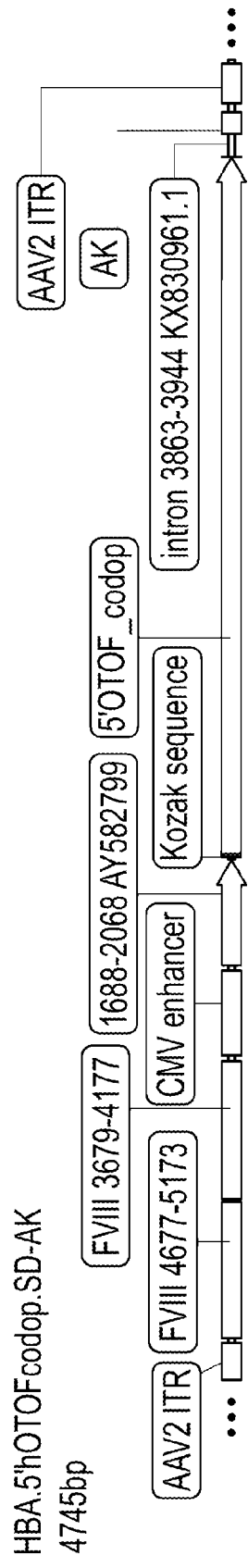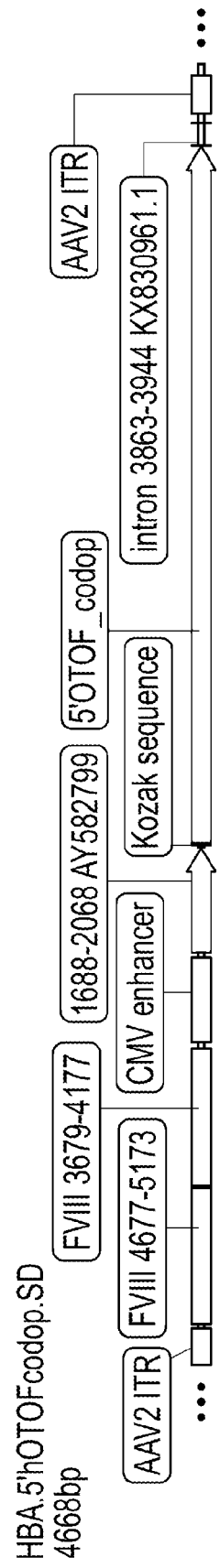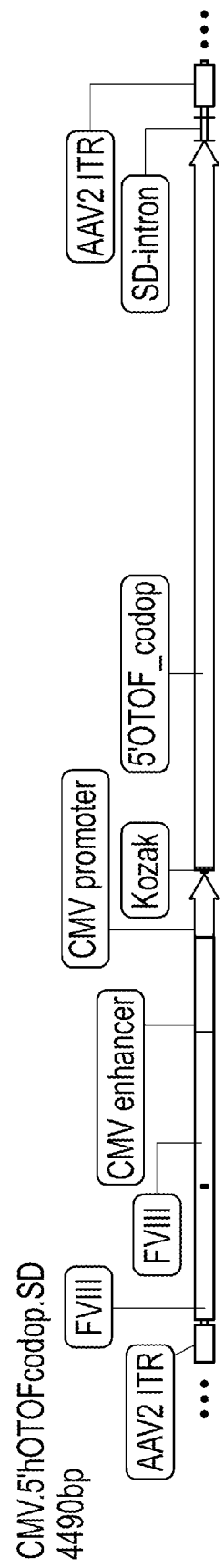
FIG. 60
FIG. 61
FIG. 62

COMPOSITIONS AND METHODS FOR TREATING NON-AGE-ASSOCIATED HEARING IMPAIRMENT IN A HUMAN SUBJECT

CROSS-REFERENCE TO RELATED APPLICATIONS

This application is a continuation of PCT Application No. PCT/US2021/018919, filed Feb. 19, 2021, which claims priority to U.S. Provisional Patent Application Ser. No. 62/979,792, filed Feb. 21, 2020, the entire contents of which are herein incorporated by reference.

SEQUENCE LISTING

The instant application contains a Sequence Listing XML which has been submitted electronically in XML format and is hereby incorporated by reference in its entirety. Said XML copy, created on Oct. 5, 2022, is name 4833_0050002_Seqlisting_ST26.xml and is 970,899 bytes in size.

TECHNICAL FIELD

The present disclosure relates generally to the use of nucleic acids to treat hearing loss in a human subject.

BACKGROUND OF THE DISCLOSURE

The ear is a complex organ, classically described as including the outer ear, the middle ear, the inner ear, the hearing (acoustic) nerve and the auditory system (which processes sound as it travels from the ear to the brain). In addition to detecting sound, the ear also helps to maintain balance. Thus, disorders of the inner ear can cause hearing loss, tinnitus, vertigo and imbalance. Vertigo is a hallucination of motion, and is the cardinal symptom of vestibular system disease. Vertigo can be caused by problems in the inner ear or central nervous system. Common inner ear causes of vertigo include: vestibular neuritis (sudden, unilateral vestibular loss), Meniere's disease (episodic vertigo), benign paroxysmal positional vertigo (BPPV), and bilateral vestibular loss. Common central nervous system causes of vertigo include: post-concussion syndrome, cervical vertigo, vestibular migraine, cerebrovascular disease, and acoustic neuroma.

Hearing loss is one of the most common human sensory deficits, and can occur for many reasons. Some people may be born with hearing loss while others may lose their hearing slowly over time. Presbycusis (also spelled presbyacusis) is age-related hearing loss. Approximately 36 million American adults report some degree of hearing loss, and one in three people older than 60 and half of those older than 85 experience hearing loss.

Hearing loss can be the result of environmental factors or a combination of genetic and environmental factors. About half of all people who have tinnitus—phantom noises in their auditory system (ringing, buzzing, chirping, humming, or beating—also have an over-sensitivity to/reduced tolerance for certain sound frequency and volume ranges, known as hyperacusis (also spelled hyperacousis). Williams syndrome (also known as Williams-Beuren Syndrome) is a multisystem disorder caused by the hemizygous deletion of a 1.6 Mb region at 7q11.23 encompassing about 26 genes, including the gene encoding LIM kinase 1 (LIMKI). Individuals with Williams Syndrome manifest hyperacusis and progressive hearing loss, and hyperacusis early onset suggests that it could be associated with one of the deleted genes.

Environmental causes of hearing loss include certain medications, specific infections before or after birth, and exposure to loud noise over an extended period. Hearing loss can result from noise, ototoxic agents, presbyacusis, disease, infection or cancers that affect specific parts of the ear. Ischemic damage can cause hearing loss via pathophysiological mechanisms initiated by. As another example, autoimmune inner ear disease (AIED) is characterized by rapidly progressive bilateral sensorineural hearing loss, occurring when the body's immune system attacks cells in the inner ear that are mistaken for a virus or bacteria.

Approximately 1.5 in 1,000 children are born with profound hearing loss, and another two to three per 1,000 children are born with partial hearing loss (Smith et al., 2005, Lancet 365:879-890). More than half of these cases are attributed to a genetic basis (Di Domenico, et al., 2011, J. Cell. Physiol. 226:2494-2499).

Nonsyndromic deafness is hearing loss that is not associated with other signs and symptoms. In contrast, syndromic deafness involves hearing loss that occurs with abnormalities in other parts of the body. Most cases of genetic deafness (70 percent to 80 percent) are nonsyndromic; the remaining cases are caused by specific genetic syndromes.

Hearing loss can be conductive (arising from the ear canal or middle ear), sensorineural (arising from the inner ear or auditory nerve), or mixed. Most forms of nonsyndromic deafness are associated with permanent hearing loss caused by damage to structures in the inner ear (sensorineural deafness). The great majority of human sensorineural hearing loss is caused by abnormalities in the hair cells of the organ of Corti in the cochlea. There are also very unusual sensorineural hearing impairments that involve the eighth cranial nerve (the vestibulocochlear nerve) or the auditory portions of the brain. In the rarest of these sorts of hearing loss, only the auditory centers of the brain are affected. In this situation, cortical deafness may occur, where sounds may be heard at normal thresholds, but the quality of the sound perceived is so poor that speech cannot be understood. However, most sensorineural hearing loss is due to poor hair cell function. The hair cells may be abnormal at birth, or damaged during the lifetime of an individual. There are both external causes of damage, like noise trauma and infection, and intrinsic abnormalities, like congenital mutations to genes that play an important role in cochlear anatomy or physiology.

Hearing loss that results from changes in the middle ear is called conductive hearing loss. Some forms of nonsyndromic deafness involve changes in both the inner ear and the middle ear, called mixed hearing loss. Hearing loss that is present before a child learns to speak is classified as prelingual or congenital. Hearing loss that occurs after the development of speech is classified as postlingual. Most autosomal recessive loci cause prelingual severe-to-profound hearing loss.

Nonsyndromic deafness can have different patterns of inheritance, and can occur at any age. Types of nonsyndromic deafness are named according to their inheritance patterns. Autosomal dominant forms are designated DFNA, autosomal recessive forms are DFNB, and X-linked forms are DFN. Each type is also numbered in the order in which it was described. For example, DFNA1 was the first described autosomal dominant type of nonsyndromic deafness.

Between 75 percent and 80 percent of cases are inherited in an autosomal recessive pattern, which means both copies of the gene in each cell have mutations. Usually, each parent of an individual with autosomal recessive deafness is a carrier of one copy of the mutated gene, but is not affected by this form of hearing loss.

Another 20 percent to 25 percent of nonsyndromic deafness cases are autosomal dominant, which means one copy of the altered gene in each cell is sufficient to result in hearing loss. People with autosomal dominant deafness most often inherit an altered copy of the gene from a parent who has hearing loss.

Between 1 percent and 2 percent of cases show an X-linked pattern of inheritance, which means the mutated gene responsible for the condition is located on the X chromosome (one of the two sex chromosomes). Males with X-linked nonsyndromic deafness tend to develop more severe hearing loss earlier in life than females who inherit a copy of the same gene mutation. A characteristic of X-linked inheritance is that fathers cannot pass X-linked traits to their sons.

Mitochondrial nonsyndromic deafness, which results from changes to mitochondrial DNA, occurs in less than one percent of cases in the United States. The altered mitochondrial DNA is passed from a mother to all of her sons and daughters. This type of deafness is not inherited from fathers.

Auditory neuropathy spectrum disorder (ANSD), a hearing disorder characterized by normal outer hair cells function and abnormal or absent auditory brain stem response, is one of the most common diseases leading to hearing and speech communication barriers in infants and young children. Approximately 10 percent of children with permanent hearing loss may have ANSD. The OTOF gene is the first gene identified for autosomal recessive non-syndromic ANSD, and mutations in OTOF have been found to account for approximately 5% of all cases of autosomal recessive nonsydromic hearing loss in some populations (Rodriguez-Ballesteros et al. 2008 *Human Mut* 29(6):823-831).

The causes of nonsyndromic deafness are complex. Researchers have identified more than 30 genes that, when altered, are associated with nonsyndromic deafness; however, some of these genes have not been fully characterized. Different mutations in the same gene can be associated with different types of hearing loss, and some genes are associated with both syndromic and nonsyndromic deafness.

For example, genes associated with nonsyndromic deafness include, but are not limited to, ATP2B2, ACTG1, CDH23, CLDN14, COCH, COL11A2, DFNA5, DFNB31, DFNB59, ESPN, EYA4, GJB3, KCNQ4, LHFPL5, MYO1A, MYO15A, MYO6, MYO7A, OTOF, PCDH15, SLC26A4, STRC, TECTA, TMC1, TMIE, TMPRSS3, TRIOBP, USHIC, and WFS1.

The most common cause of hearing loss is Nonsyndromic Hearing Loss and Deafness, DFNB1 (also called GJB2-related DFNB1 Nonsyndromic Hearing Loss and Deafness; Autosomal Recessive Deafness 1; Neurosensory Nonsyndromic Recessive Deafness 1). Nonsyndromic hearing loss and deafness (DFNB1) is characterized by congenital, non-progressive, mild-to-profound sensorineural hearing impairment. It is caused by mutations in GJB2 (which encodes the protein connexin 26) and GJB6 (which encodes connexin 30). Diagnosis of DFNB1 depends on molecular genetic testing to identify deafness-causing mutations in GJB2 and upstream cis-regulatory elements that alter the gap junction beta-2 protein (connexin 26). Molecular genetic testing of GJB2 detects more than 99% of deafness-causing mutations in these genes. Unlike some other forms of hearing loss, DFNB1 nonsyndromic hearing loss and deafness does not affect balance or movement. The degree of hearing loss is difficult to predict based on which genetic mutation one has. Even if members of the same family are affected by DFNB1 nonsyndromic hearing loss and deafness, the degree of hearing loss may vary among them.

Mutations in genes coding for connexin26 (Cx26) and/or Cx30 are linked to approximately half of all cases of human autosomal nonsyndromic prelingual deafness. Cx26 and Cx30 are the two major Cx isoforms found in the cochlea, and they coassemble to form hybrid (heteromeric and heterotypic) gap junctions (GJs) (Ahmad, et al., Proc. Natl. Acad. Sci., 2007, 104(4):1337-1341). Nonsyndromic hearing loss and deafness, DFNA3, is caused by a dominant-negative pathogenic variant in the GJB2 or GJB6 gene, altering either the protein connexin 26 (Cx26) or connexin 30 (Cx30), respectively, and is characterized by pre- or postlingual, mild to profound, progressive high-frequency sensorineural hearing impairment.

OTOF-related deafness (DFNB9 nonsyndromic hearing loss) is characterized by two phenotypes: prelingual nonsyndromic hearing loss and, less frequently, temperature-sensitive nonsyndromic auditory neuropathy (TS-NSAN). Another form of progressive hearing impairment is associated with a mutation in the otoferlin gene (e.g., a I1573T mutation or a P1987R mutation, and/or a E1700Q mutation), or is not temperature sensitive.

Pendred syndrome/DFNB4 (deafness with goiter) is an autosomal recessive inherited disorder, and accounts for 7.5% of all cases of congenital deafness. Pendred syndrome has been linked to mutations in the PDS gene (also known as DFNB4, EVA, PDS, TDH2B and solute carrier family 26, member 4, SLC26A4) on the long arm of chromosome 7 (7q31), which encodes the pendrin protein. Mutations in this gene also cause enlarged vestibular aqueduct syndrome (EVA or EVAS), another congenital cause of deafness; specific mutations are more likely to cause EVAS, while others are more linked with Pendred syndrome. (Azaiez, et al. (December 2007), Hum. Genet. 122 (5): 451-7).

Transmembrane protease, serine 3 is an enzyme encoded by the TMPRSS3 gene (also known as DFNB10, DFNB8, ECHOS1, and TADG12). The gene was identified by its association with both congenital and childhood onset autosomal recessive deafness. Mutations in TMPRSS3 are associated with postlingual and rapidly progressive hearing impairment. The protein encoded by the TMPRSS3 gene contains a serine protease domain, a transmembrane domain, an LDL receptor-like domain, and a scavenger receptor cysteine-rich domain. Serine proteases are known to be involved in a variety of biological processes, whose malfunction often leads to human diseases and disorders. This gene is expressed in fetal cochlea and many other tissues, and is thought to be involved in the development and maintenance of the inner ear or the contents of the perilymph and endolymph. This gene was also identified as a tumor associated gene that is overexpressed in ovarian tumors. Four alternatively spliced variants have been described, two of which encode identical products.

DFN3 deafness is caused by mutations in the POU3F4 gene, which is located on the X chromosome. In people with this condition, one of the small bones in the middle ear (the stapes) cannot move normally, which interferes with hearing. This characteristic sign of DFN3 is called stapes fixation. At least four other regions of the X chromosome are involved in hearing loss, but the responsible genes have not been discovered. DFNB59 (deafness, autosomal recessive 59), also known as Pejvakin or PJVK, is a 352 amino acid protein belonging to the gasdermin family in vertebrates. DFNB59 is encoded by a gene that maps to human chromosome 2q31.2, essential for the proper function of auditory pathway neurons and outer hair cell function. Mutations in DFNB59 are believed to cause non-syndromic sensorineural deafness autosomal recessive type 59, a form of sensorineural hearing impairment characterized by absent or severely abnormal auditory brainstem response but normal otoacoustic emissions (auditory neuropathy or auditory dys-synchrony). DFNB59 shares significant similarity with DFNA5, indicating that these genes share a common origin.

Alport syndrome is caused by mutations in the COL4A3, COL4A4, and COL4A5 genes involved in collagen biosynthesis. Mutations in any of these genes prevent the proper production or assembly of the type IV collagen network, which is an important structural component of basement membranes in the kidney, inner ear, and eye. One of the criteria used in diagnosis of Alport syndrome is bilateral sensorineural hearing loss in the 2000 to 8000 Hz range. The hearing loss develops gradually, is not present in early infancy and commonly presents before the age of 30 years.

Defects in ion channels are associated with deafness: DFNA2 nonsyndromic hearing loss is inherited as an autosomal dominant mutation in the KCNQ4 gene, which encodes the potassium voltage-gated channel subfamily KQT member 4 also known as voltage-gated potassium channel subunit Kv7.4. DFNA2 nonsyndromic hearing loss is characterized by symmetric, predominantly high-frequency sensorineural hearing loss (SNHL) that is progressive across all frequencies. At younger ages, hearing loss tends to be mild in the low frequencies and moderate in the high frequencies; in older persons, the hearing loss is moderate in the low frequencies and severe to profound in the high frequencies. Although the hearing impairment is often detected during routine hearing assessment of a school-age child, it is likely that hearing is impaired from birth, especially at high frequencies. Most affected persons initially require hearing aids to assist with sound amplification between ages ten and 40 years. By age 70 years, all persons with DFNA2 hearing loss have severe-to-profound hearing impairment.

Mutations in the KCNE1 and KCNQ1 genes cause Jervell and Lange-Nielsen syndrome (JLNS), a type of long QT syndrome, associated with severe, bilateral hearing loss. This condition is an autosomal recessive disorder that affects an estimated 1.6 to 6 in 1 million children, and is responsible for less than 10 percent of all cases of long QT syndrome. It has a markedly higher incidence in Norway and Sweden, up to 1:200,000. The proteins produced by the KCNE1 and KCNQ1 genes work together to form a potassium channel that transports positively charged potassium ions out of cells. The movement of potassium ions through these channels is critical for maintaining the normal functions of the inner ear and cardiac muscle.

EAST/SeSAME syndrome, characterized by mental retardation, ataxia, seizures, hearing loss, and renal salt waste, is believed to be caused by mutations in KCNJ10 inwardly rectifying potassium channels.

Subjects with Bartter's syndrome with sensorineural deafness type 4 (also known as Bartter syndrome IV or BSND) have defects in a Cl-channel accessory subunit.

Mutations in the ATP6V1B1 gene expressed both in the kidney and in the cochlea are associated with distal renal tubular acidosis (DRTA). A significant percentage of children with autosomal recessive DRTA were also found to experience progressive bilateral sensorineural hearing loss.

Usher syndrome (also known as Hallgren syndrome, Usher-Hallgren syndrome, retinitis pigmentosa-dysacusis syndrome, and dystrophia retinae dysacusis syndrome) is a rare disorder caused by a mutation in any one of at least ten genes, resulting in a combination of hearing loss and a gradual visual impairment, and is a leading cause of deaf-blindness. The hearing loss is caused by a defective inner ear, whereas the vision loss results from retinitis pigmentosa (RP), a degeneration of the retinal cells. Usher syndrome has three clinical subtypes, denoted as I, II, and III. Subjects with Usher I are born profoundly deaf and begin to lose their vision in the first decade of life, learn to walk slowly as children due to problems in their vestibular system, and exhibit balance difficulties. Subjects with Usher II are not born deaf, but do have hearing loss, but do not seem to have noticeable problems with balance; they also begin to lose their vision later (in the second decade of life) and may preserve some vision even into middle age. Subjects with Usher syndrome III are not born deaf, but experience a gradual loss of their hearing and vision; they may or may not have balance difficulties.

A mouse model of congenital deafness has been generated by making a null mutation in the gene encoding the vesicular glutamate transporter-3 (VGLUT3). Recently, hearing was restored in the VGLUT3 knockout mouse using viral-mediated gene therapy (Akil, et al., 2012, Neuron 75:283-293).

Math1 (Mouse Homolog of ATH1); also known as HATH1 or Atonal, *Drosophila*, Homolog of (ATOH1) is essential for hair cell development in the inner ear; Math1 was therefore proposed to act as a "pro-hair cell gene" in the developing sensory epithelia (Bermingham et al., 1999, Science 284:1837-1841). Several studies have now demonstrated regeneration of hair cells in injured mice cochlea and improvement of both hearing and balance with virally mediated delivery of Math1 (Baker et al., 2009, Adv. Oto-rhinolaryngol. 66:52-63; Husseman and Raphael, 2009, Adv. Otorhinolaryngol. 66:37-51; Izumikawa et al., 2008, Hear. Res. 240:52-56; Kawamoto et al., 2003, J. Neurosci. 23:4395-4400; Praetorius et al., 2010, Acta Otolaryngol. 130:215-222; Staecker et al., 2007, Otol. Neurotol. 28:223-231).

Mutations in the WFS1 gene cause more than 90 percent of Wolfram syndrome type 1 cases; Wolfram syndrome is a condition that affects many of the body's systems, most often characterized by high blood sugar levels resulting from a shortage of the hormone insulin (diabetes mellitus) and progressive vision loss due to degeneration of the nerves that carry information from the eyes to the brain (optic atrophy). However, people with Wolfram syndrome often also have pituitary gland dysfunction that results in the excretion of excessive amounts of urine (diabetes insipidus), hearing loss caused by changes in the inner ear (sensorineural deafness), urinary tract problems, reduced amounts of the sex hormone testosterone in males (hypogonadism), or neurological or psychiatric disorders. About 65 percent of people with Wolfram syndrome have sensorineural deafness that can range in severity from deafness beginning at birth to mild hearing loss beginning in adolescence that worsens over time. Furthermore, about 60 percent of people with Wolfram syndrome develop a neurological or psychiatric disorder, most commonly problems with balance and coordination (ataxia), typically beginning in early adulthood.

The WFS1 gene encodes a protein called wolframin thought to regulate the amount of calcium in cells. When Wolfram syndrome is caused by mutations in the WFS1 gene, it is inherited in an autosomal recessive pattern, and the wolframin protein has reduced or absent function. As a result, calcium levels within cells are not regulated and the endoplasmic reticulum does not work correctly. When the endoplasmic reticulum does not have enough functional wolframin, the cell triggers its own cell death (apoptosis). The death of cells in the pancreas, specifically cells that make insulin (beta cells), causes diabetes mellitus in people with Wolfram syndrome. The gradual loss of cells along the optic nerve eventually leads to blindness in affected individuals. The death of cells in other body systems likely causes the various signs and symptoms of Wolfram syndrome type 1.

Mutations in the mitochondrial genes MT-TS1 and MT-RNR1 have been found to increase the risk of developing nonsyndromic deafness. Nonsyndromic mitochondrial hearing loss and deafness is characterized by moderate-to-profound hearing loss. Pathogenic variants in MT-TS1 are usually associated with childhood onset of sensorineural hearing loss. Pathogenic variants in MT-RNR1 are associated with predisposition to hearing loss if they are exposed to certain antibiotic medications called aminoglycosides (ototoxicity) and/or late-onset sensorineural hearing loss; however, some people with a mutation in the MT-RNR1 gene develop hearing loss even without exposure to these antibiotics. Hearing loss associated with aminoglycoside ototoxicity is bilateral and severe to profound, occurring within a few days to weeks after administration of any amount (even a single dose) of an aminoglycoside antibiotic such as gentamycin, tobramycin, amikacin, kanamycin, or streptomycin.

Treatments for hearing loss currently consist of hearing amplification for mild to severe losses and cochlear implantation for severe to profound losses (Kral and O'Donoghue, 2010, N. Engl. J. Med. 363:1438-1450). To date, a majority of the research in this arena has focused on cochlear hair cell regeneration, applicable to the most common forms of hearing loss, including presbycusis, noise damage, infection, and ototoxicity.

In animal models for cochlear ischemia, ischemic damage may be prevented by compounds such as insulin-like growth factor (IGF-1), AM-111 (an apoptosis inhibitor), edarabone (a free radical scavenger), ginsenoside RB 1 (Kappo), glia-cell derived neurotrophic factor (GDNF), BDNF, CNTF, SOD1, SOD2, Necrostatin-1, DFNA5 and MSRB3. However, it appears that a combination of substances might be more effective than a single compound (e.g. complementary therapies to modulate oxidative stress, exotoxicity, blood flow, calcium and stimulation overload, apoptotic pathways, neurotrophic or hormonal control mechanisms).

Inhibition of JNK-1 induced apoptosis (mitochondria-induced) may be prevented by compounds such as dominant-negative JNK-1 and d-steroisomer JNK-1 (Mol. Pharmacol. 2007 March; 71(3):654-66; the contents of which are herein incorporated by reference in its entirety).

A long-felt need remains for agents and methods for preventing or reversing deafness.

BRIEF DESCRIPTION OF THE DRAWING

FIG. 31 is a representative schematic of a portion of pAKOS106.

FIG. 32 is a representative schematic of a portion of pAKOS107 (SEQ ID NO: 50).

FIG. 35 is a representative schematic of a portion of pAKOS108.

FIG. 36 is a representative schematic of a portion of pAKOS109 (SEQ ID NO: 52).

FIG. 37 is a representative schematic a factor VIII stuffer (SEQ ID NOs. 54-57).

FIG. 46 is a representative schematic of 1OTOF21.CL1.

FIG. 47 is a representative schematic of 22OTOF48.WPRE.

FIG. 48 is a representative schematic of 105.pA.NTF3.CMVd.

FIG. 50 is a table showing the quantitation of expression of full-length human otoferlin from three replicates of the experiment described in FIG. 49.

FIG. 60 is a representative schematic of a portion of pAAV-HBA-5'hOTOFcodop-SD-AK.

FIG. 61 is a representative schematic of a portion of pAAV-HBA-5'hOTOFcodop-SD.

FIG. 62 is a representative schematic of a portion of pAAV-CMV-5'hOTOFcodop-SD.

Figure 78:
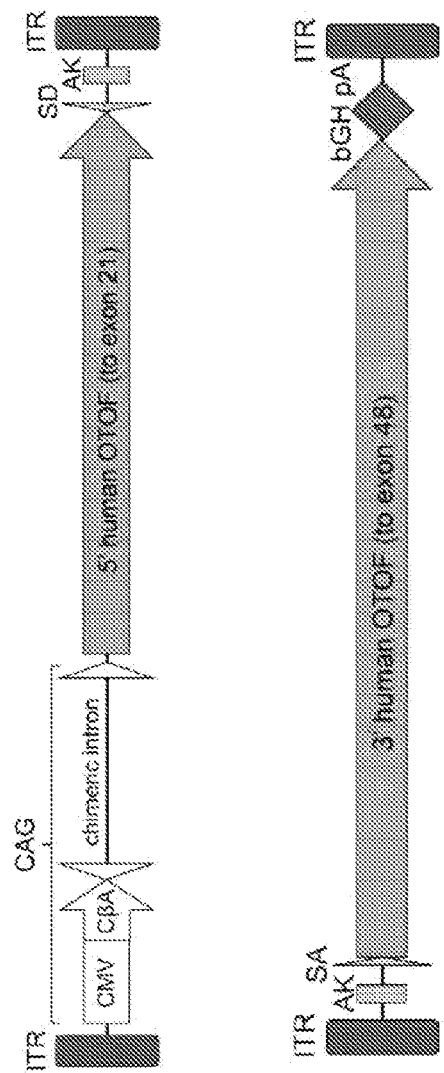

FIG. 78 is a schematic of an exemplary dual AAV vector system of the present disclosure which includes "upstream" and "downstream" vectors (AKhOTOF5 and AKhOTOF3, respectively).

Figure 79:
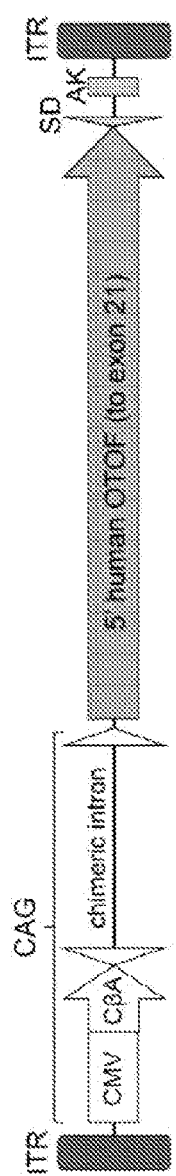

FIG. 79 is a schematic of the "upstream" vector AKhOTOF5.

Figure 80:
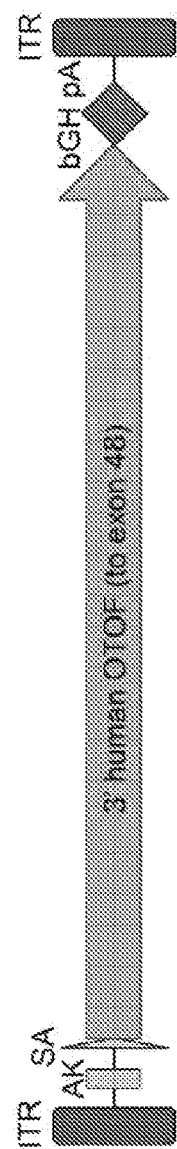

FIG. 80 is a schematic of the "downstream" vector AKhOTOF3.

Figure 81:
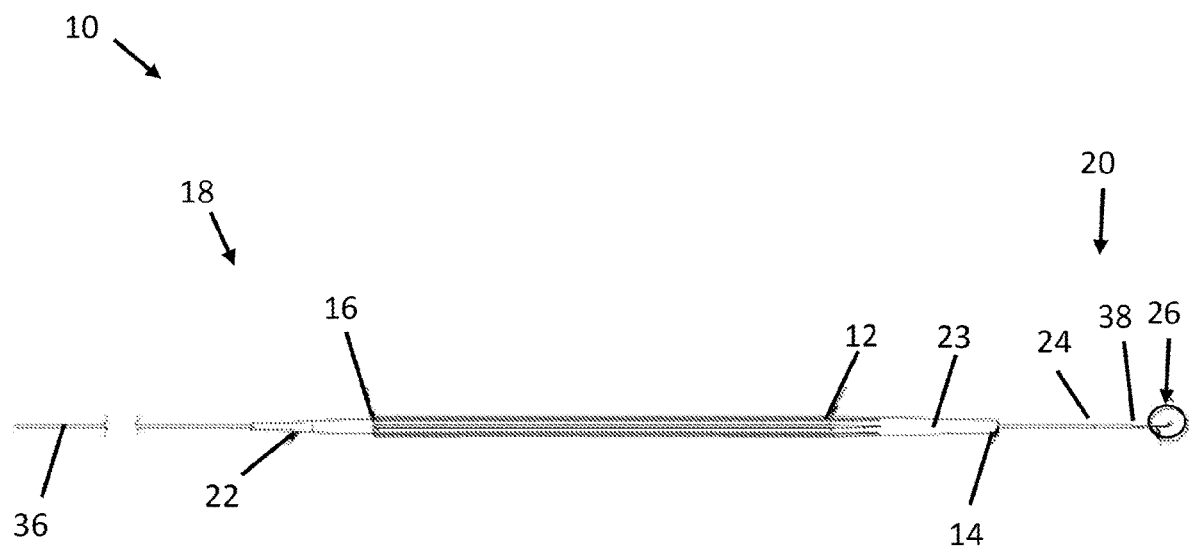

FIG. 81 illustrates a perspective of a device for delivering fluid to an inner ear, according to aspects of the present disclosure.

Figure 82:
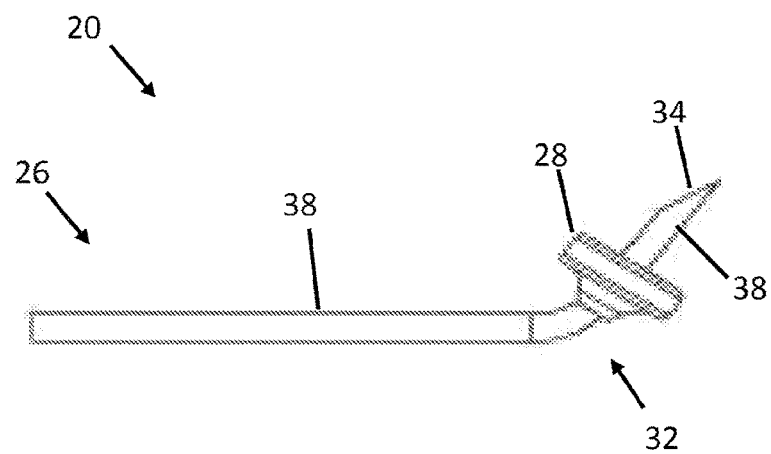

FIG. 82 illustrates a sideview of a bent needle sub-assembly, according to aspects of the present disclosure.

Figure 83:
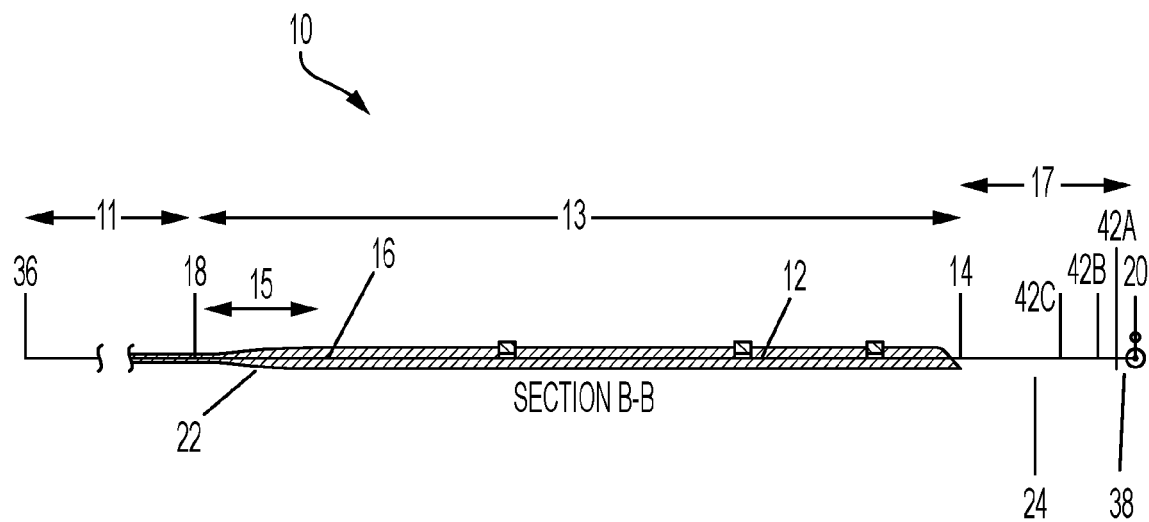

FIG. 83 illustrates a perspective view of a device for delivering fluid to an inner ear, according to aspects of the present disclosure.

Figure 84:
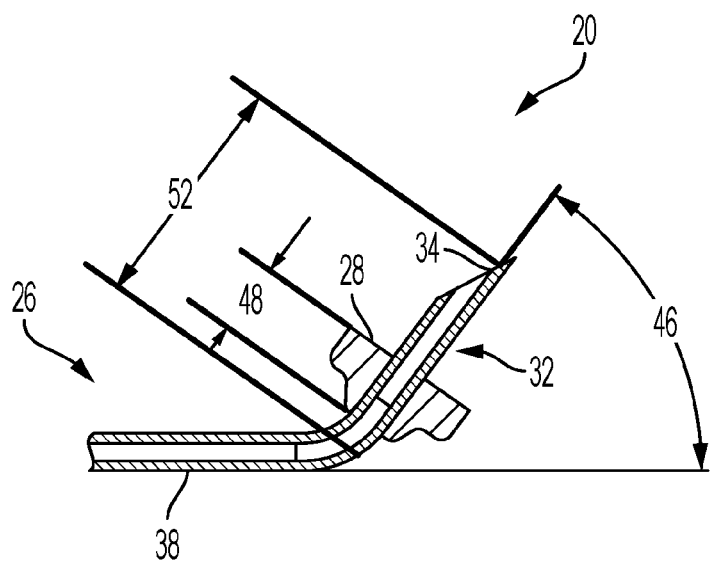

FIG. 84 illustrates a perspective view of a bent needle sub-assembly coupled to the distal end of a device, according to aspects of the present disclosure.

SUMMARY

The present disclosure is based on the discovery that a composition including at least two different nucleic acid vectors, where each of the at least two different vectors includes a coding sequence that encodes a different portion of an otoferlin protein, can be used to generate a sequence encoding an active otoferlin protein (e.g., a full-length otoferlin protein) in a mammalian cell, and thereby treat non-syndromic sensorineural hearing loss in a subject in need thereof.

Provided herein are compositions that include at least two different nucleic acid vectors, wherein: each of the at least two different vectors includes a coding sequence that encodes a different portion of an otoferlin protein, each of the encoded portions being at least 30 amino acid residues in length, wherein the amino acid sequence of each of the encoded portions may optionally partially overlap with the amino acid sequence of a different one of the encoded portions; no single vector of the at least two different vectors encodes a full-length otoferlin protein; at least one of the coding sequences includes a nucleotide sequence spanning two neighboring exons of otoferlin genomic DNA, and lacks an intronic sequence between the two neighboring exons; and when introduced into a mammalian cell the at least two different vectors undergo concatemerization or homologous recombination with each other, thereby forming a recombined nucleic acid that encodes a full-length otoferlin protein. In some embodiments of any of the compositions described herein, each of the at least two different vectors is a plasmid, a transposon, a cosmid, an artificial chromosome, or a viral vector. In some embodiments of any of the compositions described herein, each of the at least two different vectors is a human artificial chromosome (HAC), yeast artificial chromosome (YAC), bacterial artificial chromosome (BAC), or a P1-derived artificial chromosome (PAC). In some embodiments of any of the compositions described herein, each of the at least two different vectors is a viral vector selected from an adeno-associated virus (AAV) vector, an adenovirus vector, a lentivirus vector, or a retrovirus vector. In some embodiments of any of the compositions described herein, each of the at least two different vectors is an AAV vector.

In some embodiments of any of the compositions described herein, the amino acid sequence of one of the encoded portions overlaps with the amino acid sequence of a different one of the encoded portions. In some embodiments of any of the compositions described herein, the amino acid sequence of each of the encoded portions partially overlaps with the amino acid sequence of a different encoded portion. In some embodiments of any of the compositions described herein, the overlapping amino acid sequence is between about 30 amino acid residues to about 1000 amino acid residues in length.

In some embodiments of any of the compositions described herein, the vectors include two different vectors, each of which includes a different segment of an intron, wherein the intron includes the nucleotide sequence of an intron that is present in otoferlin genomic DNA, and wherein the two different segments overlap in sequence by at least 100 nucleotides. In some embodiments of any of the compositions described herein, the two different segments overlap in sequence by about 100 nucleotides to about 800 nucleotides. In some embodiments of any of the compositions described herein, the nucleotide sequence of each of the at least two different vectors is between about 500 nucleotides to about 10,000 nucleotides in length. In some embodiments of any of the compositions described herein, the nucleotide sequence of each of the at least two different vectors is between 500 nucleotides to 5,000 nucleotides in length.

In some embodiments of any of the compositions described herein, the number of different vectors in the composition is two. In some embodiments of any of the compositions described herein, a first of the two different vectors includes a coding sequence that encodes an N-terminal portion of the otoferlin protein. In some embodiments of any of the compositions described herein, the N-terminal portion of the otoferlin protein is between 30 amino acids to 1600 amino acids in length. In some embodiments of any of the compositions described herein, the N-terminal portion of the otoferlin protein is between 200 amino acids to 1500 amino acids in length. In some embodiments of any of the compositions described herein, the first vector further includes one or both of a promoter and a Kozak sequence. In some embodiments of any of the compositions described herein, the first vector includes a promoter that is an inducible promoter, a constitutive promoter, or a tissue-specific promoter.

In some embodiments of any of the compositions described herein, one of the two vectors comprises SEQ ID NO: 39 (or comprises a sequence that is at least 80%, at least 82%, at least 84%, at least 86%, at least 88%, at least 90%, at least 92%, at least 94%, at least 96%, at least 98%, or at least 99% identical to SEQ ID NO: 39) and the second of the two vectors comprises SEQ ID NO: 40 (or comprises a sequence that is at least 80%, at least 82%, at least 84%, at least 86%, at least 88%, at least 90%, at least 92%, at least 94%, at least 96%, at least 98%, or at least 99% identical to SEQ ID NO: 40). In some embodiments of any of the compositions described herein, one of the two vectors comprises SEQ ID NO: 41 (or comprises a sequence that is at least 80%, at least 82%, at least 84%, at least 86%, at least 88%, at least 90%, at least 92%, at least 94%, at least 96%, at least 98%, or at least 99% identical to SEQ ID NO: 41) and the second of the two vectors comprises SEQ ID NO: 42 (or comprises a sequence that is at least 80%, at least 82%, at least 84%, at least 86%, at least 88%, at least 90%, at least 92%, at least 94%, at least 96%, at least 98%, or at least 99% identical to SEQ ID NO: 42). In some embodiments of any of the compositions described herein, one of the two vectors comprises SEQ ID NO:84 (or comprises a sequence that is at least 80%, at least 82%, at least 84%, at least 86%, at least 88%, at least 90%, at least 92%, at least 94%, at least 96%, at least 98%, or at least 99% identical to SEQ ID NO: 84) and the second of the two vectors comprises SEQ ID NO: 85 (or comprises a sequence that is at least 80%, at least 82%, at least 84%, at least 86%, at least 88%, at least 90%, at least 92%, at least 94%, at least 96%, at least 98%, or at least 99% identical to SEQ ID NO: 85).

In some embodiments of any of the compositions described herein, wherein one of the at least two different vectors comprises a sequence encoding a NTF3 protein.

In some embodiments of any of the compositions described herein, wherein the sequence encoding a NTF3 protein is at least 80%, at least 82%, at least 84%, at least 86%, at least 88%, at least 90%, at least 92%, at least 94%, at least 96%, at least 98%, or at least 99% identical to SEQ ID NO: 78.

In some embodiments of any of the compositions described herein, the first vector further includes a coding sequence encoding a destabilization domain, wherein the destabilization domain is 3' to the coding sequence that encodes the N-terminal portion of the otoferlin protein.

In some embodiments of any of the compositions described herein, the coding sequence that encodes the N-terminal portion of the otoferlin protein comprises exons 1-21 of isoform 5 of the human otoferlin gene.

In some embodiments of any of the compositions described herein, the second of the two different vectors includes a coding sequence that encodes a C-terminal portion of the otoferlin protein. In some embodiments of any of the compositions described herein, the C-terminal portion of the otoferlin protein is between 30 amino acids to 1600 amino acids in length. In some embodiments of any of the compositions described herein, the C-terminal portion of the otoferlin protein is between 200 amino acids to 1500 amino acids in length. In some embodiments of any of the compositions described herein, the second vector further includes a poly(dA) signal sequence. In some embodiments of any of the compositions described herein, the coding sequence that encodes the C-terminal portion of the otoferlin protein comprises exons 22-48 of isoform 5 of the human otoferlin gene. In some embodiments of any of the compositions described herein, the second vector further includes sequences for mRNA stabilization. Some embodiments of any of the compositions described herein further include a pharmaceutically acceptable excipient.

Also provided herein are kits that include any of the compositions described herein. Some embodiments of any of the kits described herein further include a pre-loaded syringe containing the composition.

Also provided herein are methods that include introducing into a cochlea of a mammal a therapeutically effective amount of any of the compositions described herein. In some embodiments of any of the compositions described herein, the mammal is a human. In some embodiments of any of the compositions described herein, the mammal has been previously identified as having a defective otoferlin gene.

Also provided herein are methods of increasing expression of an active otoferlin protein, e.g., a full-length otoferlin protein, in a mammalian cell that include introducing any of the compositions described herein into the mammalian cell. In some embodiments of any of the methods described herein, the mammalian cell is a cochlear inner hair cell. In some embodiments of any of the methods described herein, the mammalian cell is a human cell. In some embodiments of any of the methods described herein, the mammalian cell has previously been determined to have a defective otoferlin gene.

Also provided herein are methods of increasing expression of an active otoferlin protein, e.g., a full-length otoferlin protein in an inner hair cell in a cochlea of a mammal that include: introducing into the cochlea of the mammal a therapeutically effective amount of any of the compositions described herein. In some embodiments of any of the methods described herein, the mammal has been previously identified as having a defective otoferlin gene. In some embodiments of any of the methods described herein, the mammal is a human.

Also provided herein are methods of treating non-syndromic sensorineural hearing loss in a subject identified as having a defective otoferlin gene that include administering a therapeutically effective amount of a composition of any one of the compositions described herein into the cochlea of the subject. In some embodiments of any of the methods described herein, the subject is a human. Some embodiments of any of the methods described herein further include, prior to the administering step, determining that the subject has a defective otoferlin gene.

Also provided herein are compositions that include two different nucleic acid vectors, wherein: a first nucleic acid vector of the two different nucleic acid vectors includes a promoter, a first coding sequence that encodes an N-terminal portion of an otoferlin protein positioned 3' of the promoter, and a splicing donor signal sequence positioned at the 3' end of the first coding sequence; and a second nucleic acid vector of the two different nucleic acid vectors includes a splicing acceptor signal sequence, a second coding sequence that encodes a C-terminal portion of an otoferlin protein positioned at the 3' end of the splicing acceptor signal sequence, and a polyadenylation sequence at the 3' end of the second coding sequence; wherein each of the encoded portions is at least 30 amino acid residues in length, wherein the amino acid sequences of the encoded portions do not overlap, wherein no single vector of the two different vectors encodes a full-length otoferlin protein, and, when the coding sequences are transcribed in a mammalian cell, to produce RNA transcripts, splicing occurs between the splicing donor signal sequence on one transcript and the splicing acceptor signal sequence on the other transcript, thereby forming a recombined RNA molecule that encodes a full-length otoferlin protein. In some embodiments of any of the compositions described herein, the coding sequence of at least one of the vectors includes a nucleotide sequence spanning two neighboring exons of otoferlin genomic DNA, and lacks an intronic sequence between the two neighboring exons.

Also provided herein are compositions that include: a first nucleic acid vector including a promoter, a first coding sequence that encodes an N-terminal portion of an otoferlin protein positioned 3' of the promoter, a splicing donor signal sequence positioned at the 3' end of the first coding sequence, and a first detectable marker gene positioned 3' of the splicing donor signal sequence; and a second nucleic acid vector, different from the first nucleic acid vector, including a second detectable marker gene, a splicing acceptor signal sequence positioned 3' of the second detectable marker gene, a second coding sequence that encodes a C-terminal portion of an otoferlin protein positioned at the 3' end of the splicing acceptor signal sequence, and a polyadenylation sequence positioned at the 3' end of the second coding sequence; wherein each of the encoded portions is at least 30 amino acid residues in length, wherein the respective amino acid sequences of the encoded portions do not overlap with each other, wherein no single vector of the two different vectors encodes a full-length otoferlin protein, and, when the coding sequences are transcribed in a mammalian cell to produce RNA transcripts, splicing occurs between the splicing donor signal on one transcript and the splicing acceptor signal on the other transcript, thereby forming a recombined RNA molecule that encodes a full-length otoferlin protein. In some embodiments of any of the compositions described herein, the coding sequence of at least one of the vectors includes a nucleotide sequence spanning two neighboring exons of otoferlin genomic DNA, and lacks an intronic sequence between the two neighboring exons. In some embodiments of any of the compositions described herein, the first or second detectable marker gene encodes alkaline phosphatase. In some embodiments of any of the compositions described herein, the first and second detectable marker genes are the same.

Also provided herein are compositions that include a first nucleic acid vector including a promoter, a first coding sequence that encodes an N-terminal portion of an otoferlin protein positioned 3' to the promoter, a splicing donor signal sequence positioned at the 3' end of the first coding sequence, and a highly recombinogenic sequence (e.g., a F1 phage recombinogenic region, e.g., SEQ ID NO: 66) positioned 3' to the splicing donor signal sequence; and a second nucleic acid vector, different from the first nucleic acid vector, including a second highly recombinogenic sequence (e.g., a F1 phage recombinogenic region, e.g., SEQ ID NO: 67, or an alkaline phosphatase recombinogenic region, e.g., SEQ ID NO: 89), a splicing acceptor signal sequence positioned 3' of the second highly recombinogenic sequence (e.g., a F1 phage recombinogenic region or an alkaline phosphatase recombinogenic region), a second coding sequence that encodes a C-terminal portion of an otoferlin protein positioned at the 3' end of the splicing acceptor signal sequence, and a polyadenylation sequence positioned at the 3' end of the second coding sequence; wherein each of the encoded portions is at least 30 amino acid residues in length, wherein the respective amino acid sequences of the encoded portions do not overlap with each other, wherein no single vector of the two different vectors encodes a full-length otoferlin protein, and, when the coding sequences are transcribed in a mammalian cell to produce RNA transcripts, splicing occurs between the splicing donor signal one transcript and the splicing acceptor signal on the other transcript, thereby forming a recombined RNA molecule that encodes a full-length otoferlin protein.

In some embodiments of any of the compositions described herein, the coding sequence of at least one of the vectors includes a nucleotide sequence spanning two neighboring exons of otoferlin genomic DNA, and lacks an intronic sequence between the two neighboring exons.

Also provided herein are kits that include any of the compositions described herein. Some embodiments of any of the kits described herein further include a pre-loaded syringe containing the composition.

Also provided herein are methods that include introducing into a cochlea of a mammal a therapeutically effective amount of any of the compositions described herein. In some embodiments of any of the methods described herein, the mammal is a human. In some embodiments of any of the methods described herein, the mammal has been previously identified as having a defective otoferlin gene.

Also provided herein are methods of increasing expression of a full-length otoferlin protein in a mammalian cell that include introducing any of the compositions described herein into the mammalian cell. In some embodiments of any of the methods described herein, the mammalian cell is a cochlear inner hair cell. In some embodiments of any of the methods described herein, the mammalian cell is a human cell. In some embodiments of any of the methods described herein, the mammalian cell has previously been determined to have a defective otoferlin gene.

Also provided herein are methods of increasing expression of a full-length otoferlin protein in an inner hair cell in a cochlea of a mammal that include introducing into the cochlea a therapeutically effective amount of any of the compositions described herein. In some embodiments of any of the methods described herein, the mammal has been previously identified as having a defective otoferlin gene. In some embodiments of any of the methods described herein, the mammal is a human.

Also provided herein are methods of treating non-symptomatic sensorineural hearing loss in a subject identified as having a defective otoferlin gene that include administering a therapeutically effective amount of any of the compositions described herein into a cochlea of the subject. In some embodiments of any of the methods described herein, the subject is a human. Some embodiments of any of the methods described herein further include, prior to the administering step, determining that the subject has a defective otoferlin gene.

Provided herein are therapeutic compositions including a plurality of adeno-associated viral (AAV) vectors, wherein the plurality of AAV vectors are capable of constituting an auditory polypeptide messenger RNA in a target cell of a human subject to whom the therapeutic composition is administered.

In some embodiments of any of the therapeutic compositions described herein, the plurality of AAV vectors are capable of constituting a full-length auditory polypeptide messenger RNA in a target cell of a human subject to whom the therapeutic composition is administered.

Some embodiments of any of the therapeutic composition described herein further include a first AAV vector and a second AAV vector, wherein the first and second AAV vectors independently contain packaging capacity of less than about 6 kb.

In some embodiments of any of the therapeutic compositions described herein, the auditory polypeptide messenger RNA encodes an auditory polypeptide selected from the group of otoferlin and an ortholog or homolog thereof.

Some embodiments of any of the therapeutic compositions described herein, can further include a nucleic acid (e.g., a vector) including a nucleic acid sequence encoding an auditory polypeptide messenger RNA encodes an auditory polypeptide selected from the group consisting of $Ca_v1.3$, a scaffold protein selected from bassoon, piccolo, ribeye, and harmonin, Vglut3, synaptotagmin, a vesicle tethering/docking protein, a vesicle priming protein, a vesicle fusion proteins, GluA2/3, and GluA4.

In some embodiments of any of the therapeutic compositions described herein, the first AAV vector further includes at least one promoter sequence selected from a CBA, a CMV, or a CB7 promoter.

In some embodiments of any of the therapeutic compositions described herein, the first AAV vector further includes at least one promoter sequence selected from Cochlea-specific promoters.

In some embodiments of any of the therapeutic compositions described herein, the therapeutic composition is formulated for intra-cochlear administration. In some embodiments of any of the therapeutic compositions described herein, the therapeutic composition is formulated to include a lipid nanoparticle. In some embodiments of any of the therapeutic compositions described herein, the therapeutic composition is formulated to include a polymeric nanoparticle. In some embodiments of any of the therapeutic compositions described herein, the therapeutic composition is formulated to include a mini-circle DNA. In some embodiments of any of the therapeutic compositions described herein, the therapeutic composition is formulated to include a CELiD DNA. In some embodiments of any of the compositions described herein, the therapeutic composition is formulated to include a synthetic perilymph solution. In some embodiments of any of the therapeutic compositions described herein, the therapeutic composition is formulated to include a synthetic perilymph solution including 20-200 mM NaCl; 1-5 mM KCl; 0.1-10 mM $CaCl_2$); 1-10 mM glucose; and 2-50 mM HEPES; and having a pH of between about 6 and about 9.

Also provided herein are therapeutic compositions that include an auditory polypeptide messenger RNA.

Also provided herein are therapeutic compositions that include one or a plurality of adenoviral (AV) vectors, where the one or the plurality of AV vectors are capable of constituting an auditory polypeptide messenger RNA in a target cell of a human subject to whom the therapeutic composition is administered.

In some embodiments of any of the therapeutic compositions described herein, the one or the plurality of AV vectors are capable of constituting a full-length auditory polypeptide messenger RNA in a target cell of a human subject to whom the therapeutic composition is administered.

Also provided herein are therapeutic compositions including one or a plurality of lentiviral vectors, where the one or the plurality of lentiviral vectors are capable of constituting an auditory polypeptide messenger RNA in a target cell of a human subject to whom the therapeutic composition is administered.

In some embodiments of any of the therapeutic compositions described herein, the one or the plurality of lentiviral vectors are capable of constituting an active, e.g., full-length auditory polypeptide messenger RNA in a target cell of a human subject to whom the therapeutic composition is administered.

Also provided herein are surgical methods that include the steps of: i) introducing into a cochlea of a human subject a first incision at a first incision point; ii) administering intra-cochlearly an effective dose of a therapeutic composition (e.g., any of the therapeutic compositions described herein).

In some embodiments of any of the methods described herein, the therapeutic composition is administered to the subject at the first incision point. In some embodiments of any of the methods described herein, the therapeutic composition is administered to the subject into or through the first incision.

In some embodiments of any of the methods described herein, the therapeutic composition is administered to the subject into or through the cochlea oval window membrane. In some embodiments of any of the methods described herein, the therapeutic composition is administered to the subject into or through the cochlea round window membrane.

In some embodiments of any of the methods described herein, the therapeutic composition is administered using a medical device capable of creating a plurality of incisions in the round window membrane.

In some embodiments of any of the methods described herein, the medical device includes a plurality of micro-needles. In some embodiments of any of the methods described herein, the medical device includes a plurality of micro-needles including a generally circular first aspect, where each micro-needle has a diameter of at least about 10 microns.

In some embodiments of any of the methods described herein, the medical device includes a base and/or a reservoir capable of holding the therapeutic composition. In some embodiments of any of the methods described herein, the medical device includes a plurality of hollow micro-needles individually including a lumen capable of transferring the therapeutic composition.

In some embodiments of any of the methods described herein, the medical device includes a means for generating at least a partial vacuum.

Also provided herein are therapeutic delivery systems, that include i) a medical device capable of creating a plurality of incisions in a round window membrane of an inner ear of a human subject in need thereof, and ii) an effective dose of a therapeutic composition including a plurality of adeno-associated viral (AAV) vectors, wherein the plurality of AAV vectors are capable of constituting an active, e.g., full-length, auditory polypeptide messenger RNA in a target cell of the inner ear.

Also provided herein are means for performing a surgical method that includes the steps of: i) administering intra-cochlearly to a human subject in need thereof an effective dose of the therapeutic composition (e.g., any of the therapeutic composition described herein), where the therapeutic composition is capable of being administered by using a medical device including a) means for creating a plurality of incisions in the round window membrane and b) the effective dose of the therapeutic composition.

In some embodiments of any of the means for performing a surgical method described herein, the medical device includes a plurality of micro-needles.

Also provided herein are therapeutic compositions that include a single adeno-associated viral (AAV) vector, where the AAV vector is capable of constituting an auditory polypeptide messenger RNA in a target cell of a human subject to whom the therapeutic composition is administered.

In some embodiments of any of the therapeutic compositions described herein, the single AAV vector is capable of constituting a full-length auditory polypeptide messenger RNA in a target cell of a human subject to whom the therapeutic composition is administered. In some embodiments of any of the methods described herein, a single vector (e.g., any of the vectors described herein) that includes a sequence encoding an active otoferlin protein (e.g., any of the full-length or truncated active otoferlin proteins described herein) can be administered to the subject.

In some embodiments of any of the therapeutic compositions described herein, the therapeutic composition further includes a second vector other than an AAV vector, where the single AAV vector and the second vector independently contain packaging capacity of less than about 6 kb.

In some embodiments of any of the therapeutic compositions described herein, the auditory polypeptide messenger RNA encodes an auditory polypeptide selected from the group of otoferlin and an ortholog or homolog thereof.

In some embodiments of any of the therapeutic compositions described herein, the auditory polypeptide messenger RNA encodes an auditory polypeptide selected from the group of otoferlin and truncation mutant thereof.

In some embodiments of any of the therapeutic compositions described herein, the otoferlin truncation mutant includes at least a single C2 domain of the following:

| C2 Domain | a.a. Designation (from Pangrsic et al. 2012 Trends Neurosci 35(11):671-680 |
|---|---|
| C2A | 1-121 |
| C2B | 256-378 |
| C2C | 419-542 |
| C2D | 962-1095 |
| C2E | 1494-1622 |
| C2F | 1734-1895 |

In some embodiments of any of the therapeutic compositions described herein, the otoferlin truncation mutant does not include an endogenous otoferlin polypeptide C-terminal region.

In some embodiments of any of the therapeutic compositions described herein, the auditory polypeptide messenger RNA encodes an auditory polypeptide selected from the group consisting of $Ca_v1.3$, a scaffold protein selected from bassoon, piccolo, ribeye, and harmonin, Vglut3, synaptotagmin, a vesicle tethering/docking protein, a vesicle priming protein, a vesicle fusion proteins, GluA2/3, and GluA4.

In some embodiments of any of the therapeutic compositions described herein, the single AAV vector further includes at least one promoter sequence selected from a CBA, a CMV, or a CB7 promoter.

In some embodiments of any of the therapeutic compositions described herein, the single AAV vector further includes at least one promoter sequence selected from a Cochlea-specific promoters.

In some embodiments of any of the therapeutic compositions described herein, the therapeutic composition is formulated for intra-cochlear administration.

In some embodiments of any of the therapeutic compositions described herein, the therapeutic composition is formulated to include a lipid nanoparticle.

In some embodiments of any of the therapeutic compositions described herein, the therapeutic composition is formulated to include a polymeric nanoparticle.

In some embodiments of any of the therapeutic compositions described herein, the therapeutic composition is formulated to include a mini-circle DNA.

In some embodiments of any of the therapeutic compositions described herein, the therapeutic composition is formulated to include a CELiD DNA.

In some embodiments of any of the therapeutic compositions described herein, the therapeutic composition is formulated to include a synthetic perilymph solution.

In some embodiments of any of the therapeutic compositions described herein, the therapeutic composition is formulated to include a synthetic perilymph solution including 20-200 mM NaCl; 1-5 mM KCl; 0.1-10 mM $CaCl_2$); 1-10 mM glucose; 2-50 mM HEPES; having a pH of between about 6 and about 9.

Also provided herein are therapeutic compositions that include an auditory polypeptide messenger RNA encoding an otoferlin truncation mutant.

Unless defined otherwise, all technical and scientific terms used herein have the same meaning as commonly understood by one of ordinary skill in the art to which the disclosure pertains.

The terms "a" and "an" refer to one or to more than one (i.e., at least one) of the grammatical object of the article. By way of example, "an element" encompasses one element and more than one element.

The term "about" when referring to a measurable value such as an amount, a temporal duration, and the like, is meant to encompass variations of up to ±20%. These variations can be, for example, up to ±10%, or in some instances ±5%, or in some instances ±1%, or in some instances ±0.1% from the specified value, as such variations are appropriate to perform the disclosed methods.

The term "signaling domain" refers to the functional portion of a protein which acts by transmitting information within the cell to regulate cellular activity via defined signaling pathways by generating second messengers or functioning as effectors by responding to such messengers. Otoferlin is believed to be a calcium sensor required for exocytosis in inner hair cells, as well as neurotransmitter release in immature outer hair cells. Five of the six C2 domains of the otoferlin protein (C2B-F) bind calcium ions with moderate and low affinity constants in solution (Kd=25-95 µM and 400-700 µM, respectively) (Padmanarayana et al. 2014 *Biochem* 53:5023-5033). In the presence of phosphatidylserine (PS), calcium concentrations of 10 µM result in significant C2-liposome interaction for the C2C-C2E domains of otoferlin. Thus, otoferlin possesses domains that appear to operate using an "electrostatic switch" mechanism, as well as domains that bind regardless of calcium. PI(4,5)P2, a major signaling molecule at the presynapse, has been shown to interact with the C2C and C2F domains of otoferlin in a calcium-independent fashion (Padmanarayana et al. 2014 *Biochem* 53:5023-5033).

The term "antibody," as used herein, refers to a protein, or polypeptide sequence derived from an immunoglobulin molecule, which specifically binds with an antigen. Antibodies can be polyclonal or monoclonal, multiple or single chain, or intact immunoglobulins, and may be derived from natural sources or from recombinant sources. Antibodies can be tetramers of immunoglobulin molecules. The term "antibody fragment" refers to at least one portion of an intact antibody, or recombinant variants thereof, and refers to the antigen binding domain, e.g., an antigenic determining variable region of an intact antibody, that is sufficient to confer recognition and specific binding of the antibody fragment to a target, such as an antigen. Examples of antibody fragments include, but are not limited to, Fab, Fab', F(ab')₂, and Fv fragments, scFv antibody fragments, linear antibodies, single domain antibodies such as sdAb (either VL or VH), camelid VHH domains, and multi-specific antibodies formed from antibody fragments. The term "scFv" refers to a fusion protein including at least one antibody fragment including a variable region of a light chain and at least one antibody fragment including a variable region of a heavy chain, wherein the light and heavy chain variable regions are contiguously linked via a short flexible polypeptide linker, and capable of being expressed as a single chain polypeptide, and wherein the scFv retains the specificity of the intact antibody from which it is derived. Unless specified, as used herein an scFv may have the VL and VH variable regions in either order, e.g., with respect to the N-terminal and C-terminal ends of the polypeptide, the scFv may comprise VL-linker-VH or may comprise VH-linker-VL.

The term "recombinant polypeptide" refers to a polypeptide which is generated using recombinant DNA technology, such as, for example, a polypeptide expressed by a viral vector expression system. The term should also be construed to mean a polypeptide which has been generated by the synthesis of a DNA molecule encoding the polypeptide and which DNA molecule expresses a protein, or an amino acid sequence specifying the polypeptide, wherein the DNA or amino acid sequence has been obtained using recombinant DNA or amino acid sequence technology which is available and well known in the art.

The term "mutation in an otoferlin gene" refers to a modification in a wildtype otoferlin gene that results in the production of an otoferlin protein having one or more of: a deletion of one or more amino acids, one or more amino acid substitutions, and one or more amino acid insertions, as compared to the wildtype otoferlin protein, and/or results in a decrease in the expressed level of the encoded otoferlin protein in a mammalian cell as compared to the expressed level of the encoded otoferlin protein in a mammalian cell not having the mutation. In some embodiments, a mutation can result in the production of an otoferlin protein having a deletion of one or more amino acids (e.g., 2, 3, 4, 5, 6, 7, 8, 9, 10, 11, 12, 13, 14, 15, 16, 17, 18, 19, or 20 amino acids). In some embodiments, the mutation can result in a frameshift in the otoferlin gene. The term "frameshift" is known in the art to encompass any mutation in a coding sequence that results in a shift in the reading frame of the coding sequence. In some embodiments, a frameshift can result in a nonfunctional protein. In some embodiments, a point mutation can be a nonsense mutation (i.e., result in a premature stop codon in an exon of the gene). A nonsense mutation can result in the production of a truncated protein (as compared to a corresponding wildtype protein) that may or may not be functional. In some embodiments, the mutation can result in the loss (or a decrease in the level) of expression of otoferlin mRNA or otoferlin protein or both the mRNA and protein. In some embodiments, the mutation can result in the production of an altered otoferlin protein having a loss or decrease in one or more biological activities (functions) as compared to a wildtype otoferlin protein.

In some embodiments, the mutation is an insertion of one or more nucleotides into an otoferlin gene. In some embodiments, the mutation is in a regulatory sequence of the otoferlin gene, i.e., a portion of the gene that is not coding sequence. In some embodiments, a mutation in a regulatory sequence may be in a promoter or enhancer region and prevent or reduce the proper transcription of the otoferlin gene.

Modifications can be introduced into a nucleotide sequence by standard techniques known in the art, such as site-directed mutagenesis and PCR-mediated mutagenesis.

The term "conservative sequence modifications" refers to amino acid modifications that do not significantly affect or alter the binding characteristics of the antibody or antibody fragment containing the amino acid sequence. Such conservative modifications include amino acid substitutions, additions, and deletions. Modifications can be introduced into an antibody or antibody fragment of the disclosure by standard techniques known in the art, such as site-directed mutagenesis and PCR-mediated mutagenesis. Conservative amino acid substitutions are ones in which the amino acid residue is replaced with an amino acid residue having a similar side chain. Families of amino acid residues having similar side chains have been defined in the art. These families include amino acids with basic side chains (e.g., lysine, arginine, and histidine), acidic side chains (e.g., aspartic acid and glutamic acid), uncharged polar side chains (e.g., glycine, asparagine, glutamine, serine, threonine, tyrosine, cysteine, and tryptophan), nonpolar side chains (e.g., alanine, valine, leucine, isoleucine, proline, phenylalanine, and methionine), beta-branched side chains (e.g., threonine, valine, and isoleucine), and aromatic side chains (e.g., tyrosine, phenylalanine, tryptophan, and histidine).

The term "encoding" refers to the inherent property of specific sequences of nucleotides in a polynucleotide, such as a gene, a cDNA, or an mRNA, to serve as templates for synthesis of a defined sequence of amino acids, in accordance with the genetic code. Thus, a gene, cDNA, or RNA encodes a protein if transcription and translation of mRNA corresponding to that gene, cDNA or RNA produces the protein.

Both the coding strand, the nucleotide sequence of which is identical to the mRNA sequence and is usually provided in sequence listings, and the non-coding strand, used as the template for transcription, can be referred to as encoding the protein product.

The term "homologous" or "identity" refers to the subunit sequence identity between two polymeric molecules, e.g., between two nucleic acid molecules, such as two DNA molecules or two RNA molecules, or between two polypeptide molecules. When a subunit position in both of the two molecules is occupied by the same monomeric subunit; e.g., if a position in each of two DNA molecules is occupied by adenine, then they are homologous or identical at that position. The homology between two sequences is a direct function of the number of matching or homologous positions; e.g., if half (e.g., five positions in a polymer ten subunits in length) of the positions in two sequences are homologous, the two sequences are 50% homologous; if 90% of the positions (e.g., 9 of 10), are matched or homologous, the two sequences are 90% homologous.

Unless otherwise specified, a "nucleotide sequence encoding an amino acid sequence" includes all nucleotide sequences that are degenerate versions of each other and thus encode the same amino acid sequence. A nucleotide sequence that encodes a protein may also include introns.

The term "endogenous" refers to any material from or produced inside an organism, cell, tissue or system.

The term "exogenous" refers to any material introduced from outside or produced outside an organism, cell, tissue or system.

The term "isolated" means altered or removed from the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell.

The term "substantially purified cell" refers to a cell that is essentially free of other cell types. A substantially purified cell also refers to a cell which has been separated from other cell types with which it is normally associated in its naturally occurring state. In some instances, a population of substantially purified cells refers to a homogenous population of cells. In other instances, this term refers simply to cells that have been separated from the cells with which they are naturally associated in their natural state. In some aspects, the cells are cultured in vitro. In other aspects, the cells are not cultured in vitro.

The term "transfected" or "transformed" or "transduced" refers to a process by which exogenous nucleic acid is transferred or introduced into the host cell. A "transfected" or "transformed" or "transduced" cell is one which has been transfected, transformed or transduced with exogenous nucleic acid. The cell includes the primary subject cell and its progeny.

The term "expression" refers to the transcription and/or translation of a particular nucleotide sequence driven by a promoter.

As used herein, "transient" refers to expression of a non-integrated transgene for a period of hours, days or weeks, wherein the period of time of expression is less than the period of time for expression of the gene if integrated into the genome or contained within a stable plasmid replicon in the host cell.

The term "subject" is intended to include living organisms in which an immune response can be elicited (e.g., mammals, human). In some embodiments, the subject is a rodent (e.g., a rat or mouse), a rabbit, a sheep, a dog, a cat, a horse, a non-human primate, or a human. In some embodiments, the subject has or is at risk of developing non-syndromic deafness. In some embodiments, the subject has been previously identified as having a mutation in an otoferlin gene. In some embodiments, the subject has been identified as having a mutation in an otoferlin gene and has been diagnosed with non-symptomatic sensorineural hearing loss. In some embodiments, the subject has been identified as having non-symptomatic sensorineural hearing loss.

The term "therapeutic" as used herein means a treatment. A therapeutic effect is obtained by reduction, suppression, remission, or eradication of a disease state.

The term "prophylaxis" as used herein means the prevention of, or protective treatment for, a disease or disease state. "Prevention" in this context includes reducing the likelihood the subject will experience the disease.

The term "effective amount" or "therapeutically effective amount" are used interchangeably herein, and refer to an amount of a compound, formulation, material, or composition as described herein effective to achieve a particular biological result. In some embodiments, a therapeutically effective amount of a composition can result in an increase in the expression level of an active otoferlin protein (e.g., a wildtype, full-length otoferlin protein or of a variant of an otoferlin protein that has the desired activity) (e.g., as compared to the expression level prior to treatment with the composition). In some embodiments, a therapeutically effective amount of a composition can result in an increase in the expression level of an active otoferlin protein (e.g., a wildtype, full-length otoferlin protein or active variant) in a target cell (e.g., a cochlear inner hair cell). In some embodiments, a therapeutically effective amount of a composition can result in a different cellular localization of an active otoferlin protein (e.g., a wildtype, full-length otoferlin protein or an active variant) in a target cell (e.g., a cochlear inner hair cell). In some embodiments, a therapeutically effective amount of a composition can result in an increase in the expression level of an active otoferlin protein (e.g., a wildtype, full-length otoferlin protein or active variant), and/or an increase in one or more activities of an otoferlin protein in a target cell (e.g., as compared to a reference level, such as the level(s) in a subject prior to treatment, the level(s) in a subject having a mutation in an otoferlin gene, or the level(s) in a subject or a population of subjects having non-symptomatic sensorineural hearing loss).

The term "parenteral" administration of a composition includes, e.g., subcutaneous (s.c.), intravenous (i.v.), intramuscular (i.m.), or intrasternal injection, or infusion techniques.

The term "nucleic acid" or "polynucleotide" refers to deoxyribonucleic acids (DNA) or ribonucleic acids (RNA) and polymers thereof in either single- or double-stranded form. Unless specifically limited, the term encompasses nucleic acids containing known analogues of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions), alleles, orthologs, SNPs, and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., Nucleic Acid Res. 19:5081 (1991); Ohtsuka et al., J. Biol. Chem. 260:2605-2608 (1985); and Rossolini et al., Mol. Cell. Probes 8:91-98 (1994)).

In some embodiments of any of the nucleic acids described herein, the nucleic acid is DNA. In some embodiments of any of the nucleic acids described herein, the nucleic acid is RNA.

In the context of the present disclosure, the following abbreviations for the commonly occurring nucleic acid bases are used. "A" refers to adenosine, "C" refers to cytosine, "G" refers to guanosine, "T" refers to thymidine, and "U" refers to uridine.

As used herein, "in vitro transcribed RNA" refers to RNA, preferably mRNA, that has been synthesized in vitro. Generally, the in vitro transcribed RNA is generated from an in vitro transcription vector. The in vitro transcription vector includes a template that is used to generate the in vitro transcribed RNA.

The terms "peptide," "polypeptide," and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein including two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. A polypeptide includes a natural peptide, a recombinant peptide, or a combination thereof.

The term "signal transduction pathway" refers to the biochemical relationship between a variety of signal transduction molecules that play a role in the transmission of a signal from one portion of a cell to another portion of a cell. The phrase "cell surface receptor" includes molecules and complexes of molecules capable of receiving a signal and transmitting signal across the membrane of a cell.

The term "active otoferlin protein" means a protein encoded by DNA that, if substituted for both wildtype alleles encoding full-length otoferlin protein in auditory hair cells (e.g., auditory inner hair cells) of what is otherwise a wildtype mammal, and if expressed in the auditory hair cells of that mammal, results in that mammal's having a level of hearing approximating the normal level of hearing of a similar mammal that is entirely wildtype. Non-limiting examples of active otoferlin proteins are full-length otoferlin proteins (e.g., any of the full-length otoferlin proteins described herein).

For example, an active otoferlin protein can include a sequence of a wildtype, full-length otoferlin protein (e.g., a wildtype, human, full-length otoferlin protein) including 1 amino acid substitution to about 240 amino acid substitutions, 1 amino acid substitution to about 235 amino acid substitutions, 1 amino acid substitution to about 230 amino acid substitutions, 1 amino acid substitution to about 225 amino acid substitutions, 1 amino acid substitution to about 220 amino acid substitutions, 1 amino acid substitution to about 215 amino acid substitutions, 1 amino acid substitution to about 210 amino acid substitutions, 1 amino acid substitution to about 205 amino acid substitutions, 1 amino acid substitution to about 200 amino acid substitutions, 1 amino acid substitution to about 195 amino acid substitutions, 1 amino acid substitution to about 190 amino acid substitutions, 1 amino acid substitution to about 185 amino acid substitutions, 1 amino acid substitution to about 180 amino acid substitutions, 1 amino acid substitution to about 175 amino acid substitutions, 1 amino acid substitution to about 170 amino acid substitutions, 1 amino acid substitution to about 165 amino acid substitutions, 1 amino acid substitution to about 160 amino acid substitutions, 1 amino acid substitution to about 155 amino acid substitutions, 1 amino acid substitution to about 150 amino acid substitutions, 1 amino acid substitution to about 145 amino acid substitutions, 1 amino acid substitution to about 140 amino acid substitutions, 1 amino acid substitution to about 135 amino acid substitutions, 1 amino acid substitution to about 130 amino acid substitutions, 1 amino acid substitution to about 125 amino acid substitutions, 1 amino acid substitution to about 120 amino acid substitutions, 1 amino acid substitution to about 115 amino acid substitutions, 1 amino acid substitution to about 110 amino acid substitutions, 1 amino acid substitution to about 105 amino acid substitutions, 1 amino acid substitution to about 100 amino acid substitutions, 1 amino acid substitution to about 95 amino acid substitutions, 1 amino acid substitution to about 90 amino acid substitutions, 1 amino acid substitution to about 85 amino acid substitutions, 1 amino acid substitution to about 80 amino acid substitutions, 1 amino acid substitution to about 75 amino acid substitutions, 1 amino acid substitution to about 70 amino acid substitutions, 1 amino acid substitution to about 65 amino acid substitutions, 1 amino acid substitution to about 60 amino acid substitutions, 1 amino acid substitution to about 55 amino acid substitutions, 1 amino acid substitution to about 50 amino acid substitutions, 1 amino acid substitution to about 45 amino acid substitutions, 1 amino acid substitution to about 40 amino acid substitutions, 1 amino acid substitution to about 35 amino acid substitutions, 1 amino acid substitution to about 30 amino acid substitutions, 1 amino acid substitution to about 25 amino acid substitutions, 1 amino acid substitution to about 20 amino acid substitutions, 1 amino acid substitution to about 15 amino acid substitutions, 1 amino acid substitution to about 10 amino acid substitutions, 1 amino acid substitution to about 9 amino acid substitutions, 1 amino acid substitution to about 8 amino acid substitutions, 1 amino acid substitution to about 7 amino acid substitutions, 1 amino acid substitution to about 6 amino acid substitutions, 1 amino acid substitution to about 5 amino acid substitutions, 1 amino acid substitution to about 4 amino acid substitutions, 1 amino acid substitution to about 3 amino acid substitutions, between about 2 amino acid substitutions to about 240 amino acid substitutions, about 2 amino acid substitutions to about 235 amino acid substitutions, about 2 amino acid substitutions to about 230 amino acid substitutions, about 2 amino acid substitutions to about 225 amino acid substitutions, about 2 amino acid substitutions substitution to about 220 amino acid substitutions, about 2 amino acid substitutions to about 215 amino acid substitutions, about 2 amino acid substitutions to about 210 amino acid substitutions, about 2 amino acid substitutions to about 205 amino acid substitutions, about 2 amino acid substitutions to about 200 amino acid substitutions, about 2 amino acid substitutions to about 195 amino acid substitutions, about 2 amino acid substitutions to about 190 amino acid substitutions, about 2 amino acid substitutions to about 185 amino acid substitutions, about 2 amino acid substitutions to about 180 amino acid substitutions, about 2 amino acid substitutions to about 175 amino acid substitutions, about 2 amino acid substitutions to about 170 amino acid substitutions, about 2 amino acid substitutions to about 165 amino acid substitutions, about 2 amino acid substitutions to about 160 amino acid substitutions, about 2 amino acid substitutions to about 155 amino acid substitutions, about 2 amino acid substitutions to about 150 amino acid substitutions, about 2 amino acid substitutions to about 145 amino acid substitutions, about 2 amino acid substitutions to about 140 amino acid substitutions, about 2 amino acid substitutions to about 135 amino acid substitutions, about 2 amino acid substitutions to about 130 amino acid substitutions, about 2 amino acid substitutions to about 125 amino acid substitutions, about 2 amino acid substitutions to about 120 amino acid substitutions, about 2 amino acid substitutions to about 115 amino acid substitutions, about 2 amino acid substitutions to about 110 amino acid substitutions, about 2 amino acid substitutions to about 105 amino acid substitutions, about 2 amino acid substitutions to about 100 amino acid substitutions, about 2 amino acid substitutions to about 95 amino acid substitutions, about 2 amino acid substitutions to about 90 amino acid substitutions, about 2 amino acid substitutions to about 85 amino acid substitutions, about 2 amino acid substitutions to about 80 amino acid substitutions, about 2 amino acid substitutions to about 75 amino acid substitutions, about 2 amino acid substitutions to about 70 amino acid substitutions, about 2 amino acid substitutions to about 65 amino acid substitutions, about 2 amino acid substitutions to about 60 amino acid substitutions, about 2 amino acid substitutions to about 55 amino acid substitutions, about 2 amino acid substitutions to about 50 amino acid substitutions, about 2 amino acid substitutions to about 45 amino acid substitutions, about 2 amino acid substitutions to about 40 amino acid substitutions, about 2 amino acid substitutions to about 35 amino acid substitutions, about 2 amino acid substitutions to about 30 amino acid substitutions, about 2 amino acid substitutions to about 25 amino acid substitutions, about 2 amino acid substitutions to about 20 amino acid substitutions, about 2 amino acid substitutions to about 15 amino acid substitutions, about 2 amino acid substitutions to about 10 amino acid substitutions, about 2 amino acid substitutions to about 9 amino acid substitutions, about 2 amino acid substitutions to about 8 amino acid substitutions, about 2 amino acid substitutions to about 7 amino acid substitutions, about 2 amino acid substitutions to about 6 amino acid substitutions, about 2 amino acid substitutions to about 5 amino acid substitutions, about 2 amino acid substitutions to about 4 amino acid substitutions, between about 3 amino acid substitutions to about 240 amino acid substitutions, about 3 amino acid substitutions to about 235 amino acid substitutions, about 3 amino acid substitutions to about 230 amino acid substitutions, about 3 amino acid substitutions to about 225 amino acid substitutions, about 3 amino acid substitutions substitution to about 220 amino acid substitutions, about 3 amino acid substitutions to about 215 amino acid substitutions, about 3 amino acid substitutions to about 210 amino acid substitutions, about 3 amino acid substitutions to about 205 amino acid substitutions, about 3 amino acid substitutions to about 200 amino acid substitutions, about 3 amino acid substitutions to about 195 amino acid substitutions, about 3 amino acid substitutions to about 190 amino acid substitutions, about 3 amino acid substitutions to about 185 amino acid substitutions, about 3 amino acid substitutions to about 180 amino acid substitutions, about 3 amino acid substitutions to about 175 amino acid substitutions, about 3 amino acid substitutions to about 170 amino acid substitutions, about 3 amino acid substitutions to about 165 amino acid substitutions, about 3 amino acid substitutions to about 160 amino acid substitutions, about 3 amino acid substitutions to about 155 amino acid substitutions, about 3 amino acid substitutions to about 150 amino acid substitutions, about 3 amino acid substitutions to about 145 amino acid substitutions, about 3 amino acid substitutions to about 140 amino acid substitutions, about 3 amino acid substitutions to about 135 amino acid substitutions, about 3 amino acid substitutions to about 130 amino acid substitutions, about 3 amino acid substitutions to about 125 amino acid substitutions, about 3 amino acid substitutions to about 120 amino acid substitutions, about 3 amino acid substitutions to about 115 amino acid substitutions, about 3 amino acid substitutions to about 110 amino acid substitutions, about 3 amino acid substitutions to about 105 amino acid substitutions, about 3 amino acid substitutions to about 100 amino acid substitutions, about 3 amino acid substitutions to about 95 amino acid substitutions, about 3 amino acid substitutions to about 90 amino acid substitutions, about 3 amino acid substitutions to about 85 amino acid substitutions, about 3 amino acid substitutions to about 80 amino acid substitutions, about 3 amino acid substitutions to about 75 amino acid substitutions, about 3 amino acid substitutions to about 70 amino acid substitutions, about 3 amino acid substitutions to about 65 amino acid substitutions, about 3 amino acid substitutions to about 60 amino acid substitutions, about 3 amino acid substitutions to about 55 amino acid substitutions, about 3 amino acid substitutions to about 50 amino acid substitutions, about 3 amino acid substitutions to about 45 amino acid substitutions, about 3 amino acid substitutions to about 40 amino acid substitutions, about 3 amino acid substitutions to about 35 amino acid substitutions, about 3 amino acid substitutions to about 30 amino acid substitutions, about 3 amino acid substitutions to about 25 amino acid substitutions, about 3 amino acid substitutions to about 20 amino acid substitutions, about 3 amino acid substitutions to about 15 amino acid substitutions, about 3 amino acid substitutions to about 10 amino acid substitutions, about 3 amino acid substitutions to about 9 amino acid substitutions, about 3 amino acid substitutions to about 8 amino acid substitutions, about 3 amino acid substitutions to about 7 amino acid substitutions, about 3 amino acid substitutions to about 6 amino acid substitutions, about 3 amino acid substitutions to about 5 amino acid substitutions, between about 4 amino acid substitutions to about 240 amino acid substitutions, about 4 amino acid substitutions to about 235 amino acid substitutions, about 4 amino acid substitutions to about 230 amino acid substitutions, about 4 amino acid substitutions to about 225 amino acid substitutions, about 4 amino acid substitutions substitution to about 220 amino acid substitutions, about 4 amino acid substitutions to about 215 amino acid substitutions, about 4 amino acid substitutions to about 210 amino acid substitutions, about 4 amino acid substitutions to about 205 amino acid substitutions, about 4 amino acid substitutions to about 200 amino acid substitutions, about 4 amino acid substitutions to about 195 amino acid substitutions, about 4 amino acid substitutions to about 190 amino acid substitutions, about 4 amino acid substitutions to about 185 amino acid substitutions, about 4 amino acid substitutions to about 180 amino acid substitutions, about 4 amino acid substitutions to about 175 amino acid substitutions, about 4 amino acid substitutions to about 170 amino acid substitutions, about 4 amino acid substitutions to about 165 amino acid substitutions, about 4 amino acid substitutions to about 160 amino acid substitutions, about 4 amino acid substitutions to about 155 amino acid substitutions, about 4 amino acid substitutions to about 150 amino acid substitutions, about 4 amino acid substitutions to about 145 amino acid substitutions, about 4 amino acid substitutions to about 140 amino acid substitutions, about 4 amino acid substitutions to about 135 amino acid substitutions, about 4 amino acid substitutions to about 130 amino acid substitutions, about 4 amino acid substitutions to about 125 amino acid substitutions, about 4 amino acid substitutions to about 120 amino acid substitutions, about 4 amino acid substitutions to about 115 amino acid substitutions, about 4 amino acid substitutions to about 110 amino acid substitutions, about 4 amino acid substitutions to about 105 amino acid substitutions, about 4 amino acid substitutions to about 100 amino acid substitutions, about 4 amino acid substitutions to about 95 amino acid substitutions, about 4 amino acid substitutions to about 90 amino acid substitutions, about 4 amino acid substitutions to about 85 amino acid substitutions, about 4 amino acid substitutions to about 80 amino acid substitutions, about 4 amino acid substitutions to about 75 amino acid substitutions, about 4 amino acid substitutions to about 70 amino acid substitutions, about 4 amino acid substitutions to about 65 amino acid substitutions, about 4 amino acid substitutions to about 60 amino acid substitutions, about 4 amino acid substitutions to about 55 amino acid substitutions, about 4 amino acid substitutions to about 50 amino acid substitutions, about 4 amino acid substitutions to about 45 amino acid substitutions, about 4 amino acid substitutions to about 40 amino acid substitutions, about 4 amino acid substitutions to about 35 amino acid substitutions, about 4 amino acid substitutions to about 30 amino acid substitutions, about 4 amino acid substitutions to about 25 amino acid substitutions, about 4 amino acid substitutions to about 20 amino acid substitutions, about 4 amino acid substitutions to about 15 amino acid substitutions, about 4 amino acid substitutions to about 10 amino acid substitutions, about 4 amino acid substitutions to about 9 amino acid substitutions, about 4 amino acid substitutions to about 8 amino acid substitutions, about 4 amino acid substitutions to about 7 amino acid substitutions, about 4 amino acid substitutions to about 6 amino acid substitutions, between about 5 amino acid substitutions to about 240 amino acid substitutions, about 5 amino acid substitutions to about 235 amino acid substitutions, about 5 amino acid substitutions to about 230 amino acid substitutions, about 5 amino acid substitutions to about 225 amino acid substitutions, about 5 amino acid substitutions substitution to about 220 amino acid substitutions, about 5 amino acid substitutions to about 215 amino acid substitutions, about 5 amino acid substitutions to about 210 amino acid substitutions, about 5 amino acid substitutions to about 205 amino acid substitutions, about 5 amino acid substitutions to about 200 amino acid substitutions, about 5 amino acid substitutions to about 195 amino acid substitutions, about 5 amino acid substitutions to about 190 amino acid substitutions, about 5 amino acid substitutions to about 185 amino acid substitutions, about 5 amino acid substitutions to about 180 amino acid substitutions, about 5 amino acid substitutions to about 175 amino acid substitutions, about 5 amino acid substitutions to about 170 amino acid substitutions, about 5 amino acid substitutions to about 165 amino acid substitutions, about 5 amino acid substitutions to about 160 amino acid substitutions, about 5 amino acid substitutions to about 155 amino acid substitutions, about 5 amino acid substitutions to about 150 amino acid substitutions, about 5 amino acid substitutions to about 145 amino acid substitutions, about 5 amino acid substitutions to about 140 amino acid substitutions, about 5 amino acid substitutions to about 135 amino acid substitutions, about 5 amino acid substitutions to about 130 amino acid substitutions, about 5 amino acid substitutions to about 125 amino acid substitutions, about 5 amino acid substitutions to about 120 amino acid substitutions, about 5 amino acid substitutions to about 115 amino acid substitutions, about 5 amino acid substitutions to about 110 amino acid substitutions, about 5 amino acid substitutions to about 105 amino acid substitutions, about 5 amino acid substitutions to about 100 amino acid substitutions, about 5 amino acid substitutions to about 95 amino acid substitutions, about 5 amino acid substitutions to about 90 amino acid substitutions, about 5 amino acid substitutions to about 85 amino acid substitutions, about 5 amino acid substitutions to about 80 amino acid substitutions, about 5 amino acid substitutions to about 75 amino acid substitutions, about 5 amino acid substitutions to about 70 amino acid substitutions, about 5 amino acid substitutions to about 65 amino acid substitutions, about 5 amino acid substitutions to about 60 amino acid substitutions, about 5 amino acid substitutions to about 55 amino acid substitutions, about 5 amino acid substitutions to about 50 amino acid substitutions, about 5 amino acid substitutions to about 45 amino acid substitutions, about 5 amino acid substitutions to about 40 amino acid substitutions, about 5 amino acid substitutions to about 35 amino acid substitutions, about 5 amino acid substitutions to about 30 amino acid substitutions, about 5 amino acid substitutions to about 25 amino acid substitutions, about 5 amino acid substitutions to about 20 amino acid substitutions, about 5 amino acid substitutions to about 15 amino acid substitutions, about 5 amino acid substitutions to about 10 amino acid substitutions, about 5 amino acid substitutions to about 9 amino acid substitutions, about 5 amino acid substitutions to about 8 amino acid substitutions, about 5 amino acid substitutions to about 7 amino acid substitutions, between about 6 amino acid substitutions to about 240 amino acid substitutions, about 6 amino acid substitutions to about 235 amino acid substitutions, about 6 amino acid substitutions to about 230 amino acid substitutions, about 6 amino acid substitutions to about 225 amino acid substitutions, about 6 amino acid substitutions substitution to about 220 amino acid substitutions, about 6 amino acid substitutions to about 215 amino acid substitutions, about 6 amino acid substitutions to about 210 amino acid substitutions, about 6 amino acid substitutions to about 205 amino acid substitutions, about 6 amino acid substitutions to about 200 amino acid substitutions, about 6 amino acid substitutions to about 195 amino acid substitutions, about 6 amino acid substitutions to about 190 amino acid substitutions, about 6 amino acid substitutions to about 185 amino acid substitutions, about 6 amino acid substitutions to about 180 amino acid substitutions, about 6 amino acid substitutions to about 175 amino acid substitutions, about 6 amino acid substitutions to about 170 amino acid substitutions, about 6 amino acid substitutions to about 165 amino acid substitutions, about 6 amino acid substitutions to about 160 amino acid substitutions, about 6 amino acid substitutions to about 155 amino acid substitutions, about 6 amino acid substitutions to about 150 amino acid substitutions, about 6 amino acid substitutions to about 145 amino acid substitutions, about 6 amino acid substitutions to about 140 amino acid substitutions, about 6 amino acid substitutions to about 135 amino acid substitutions, about 6 amino acid substitutions to about 130 amino acid substitutions, about 6 amino acid substitutions to about 125 amino acid substitutions, about 6 amino acid substitutions to about 120 amino acid substitutions, about 6 amino acid substitutions to about 115 amino acid substitutions, about 6 amino acid substitutions to about 110 amino acid substitutions, about 6 amino acid substitutions to about 105 amino acid substitutions, about 6 amino acid substitutions to about 100 amino acid substitutions, about 6 amino acid substitutions to about 95 amino acid substitutions, about 6 amino acid substitutions to about 90 amino acid substitutions, about 6 amino acid substitutions to about 85 amino acid substitutions, about 6 amino acid substitutions to about 80 amino acid substitutions, about 6 amino acid substitutions to about 75 amino acid substitutions, about 6 amino acid substitutions to about 70 amino acid substitutions, about 6 amino acid substitutions to about 65 amino acid substitutions, about 6 amino acid substitutions to about 60 amino acid substitutions, about 6 amino acid substitutions to about 55 amino acid substitutions, about 6 amino acid substitutions to about 50 amino acid substitutions, about 6 amino acid substitutions to about 45 amino acid substitutions, about 6 amino acid substitutions to about 40 amino acid substitutions, about 6 amino acid substitutions to about 35 amino acid substitutions, about 6 amino acid substitutions to about 30 amino acid substitutions, about 6 amino acid substitutions to about 25 amino acid substitutions, about 6 amino acid substitutions to about 20 amino acid substitutions, about 6 amino acid substitutions to about 15 amino acid substitutions, about 6 amino acid substitutions to about 10 amino acid substitutions, about 6 amino acid substitutions to about 9 amino acid substitutions, about 6 amino acid substitutions to about 8 amino acid substitutions, between about 7 amino acid substitutions to about 240 amino acid substitutions, about 7 amino acid substitutions to about 235 amino acid substitutions, about 7 amino acid substitutions to about 230 amino acid substitutions, about 7 amino acid substitutions to about 225 amino acid substitutions, about 7 amino acid substitutions substitution to about 220 amino acid substitutions, about 7 amino acid substitutions to about 215 amino acid substitutions, about 7 amino acid substitutions to about 210 amino acid substitutions, about 7 amino acid substitutions to about 205 amino acid substitutions, about 7 amino acid substitutions to about 200 amino acid substitutions, about 7 amino acid substitutions to about 195 amino acid substitutions, about 7 amino acid substitutions to about 190 amino acid substitutions, about 7 amino acid substitutions to about 185 amino acid substitutions, about 7 amino acid substitutions to about 180 amino acid substitutions, about 7 amino acid substitutions to about 175 amino acid substitutions, about 7 amino acid substitutions to about 170 amino acid substitutions, about 7 amino acid substitutions to about 165 amino acid substitutions, about 7 amino acid substitutions to about 160 amino acid substitutions, about 7 amino acid substitutions to about 155 amino acid substitutions, about 7 amino acid substitutions to about 150 amino acid substitutions, about 7 amino acid substitutions to about 145 amino acid substitutions, about 7 amino acid substitutions to about 140 amino acid substitutions, about 7 amino acid substitutions to about 135 amino acid substitutions, about 7 amino acid substitutions to about 130 amino acid substitutions, about 7 amino acid substitutions to about 125 amino acid substitutions, about 7 amino acid substitutions to about 120 amino acid substitutions, about 7 amino acid substitutions to about 115 amino acid substitutions, about 7 amino acid substitutions to about 110 amino acid substitutions, about 7 amino acid substitutions to about 105 amino acid substitutions, about 7 amino acid substitutions to about 100 amino acid substitutions, about 7 amino acid substitutions to about 95 amino acid substitutions, about 7 amino acid substitutions to about 90 amino acid substitutions, about 7 amino acid substitutions to about 85 amino acid substitutions, about 7 amino acid substitutions to about 80 amino acid substitutions, about 7 amino acid substitutions to about 75 amino acid substitutions, about 7 amino acid substitutions to about 70 amino acid substitutions, about 7 amino acid substitutions to about 65 amino acid substitutions, about 7 amino acid substitutions to about 60 amino acid substitutions, about 7 amino acid substitutions to about 55 amino acid substitutions, about 7 amino acid substitutions to about 50 amino acid substitutions, about 7 amino acid substitutions to about 45 amino acid substitutions, about 7 amino acid substitutions to about 40 amino acid substitutions, about 7 amino acid substitutions to about 35 amino acid substitutions, about 7 amino acid substitutions to about 30 amino acid substitutions, about 7 amino acid substitutions to about 25 amino acid substitutions, about 7 amino acid substitutions to about 20 amino acid substitutions, about 7 amino acid substitutions to about 15 amino acid substitutions, about 7 amino acid substitutions to about 10 amino acid substitutions, about 7 amino acid substitutions to about 9 amino acid substitutions, between about 8 amino acid substitutions to about 240 amino acid substitutions, about 8 amino acid substitutions to about 235 amino acid substitutions, about 8 amino acid substitutions to about 230 amino acid substitutions, about 8 amino acid substitutions to about 225 amino acid substitutions, about 8 amino acid substitutions substitution to about 220 amino acid substitutions, about 8 amino acid substitutions to about 215 amino acid substitutions, about 8 amino acid substitutions to about 210 amino acid substitutions, about 8 amino acid substitutions to about 205 amino acid substitutions, about 8 amino acid substitutions to about 200 amino acid substitutions, about 8 amino acid substitutions to about 195 amino acid substitutions, about 8 amino acid substitutions to about 190 amino acid substitutions, about 8 amino acid substitutions to about 185 amino acid substitutions, about 8 amino acid substitutions to about 180 amino acid substitutions, about 8 amino acid substitutions to about 175 amino acid substitutions, about 8 amino acid substitutions to about 170 amino acid substitutions, about 8 amino acid substitutions to about 165 amino acid substitutions, about 8 amino acid substitutions to about 160 amino acid substitutions, about 8 amino acid substitutions to about 155 amino acid substitutions, about 8 amino acid substitutions to about 150 amino acid substitutions, about 8 amino acid substitutions to about 145 amino acid substitutions, about 8 amino acid substitutions to about 140 amino acid substitutions, about 8 amino acid substitutions to about 135 amino acid substitutions, about 8 amino acid substitutions to about 130 amino acid substitutions, about 8 amino acid substitutions to about 125 amino acid substitutions, about 8 amino acid substitutions to about 120 amino acid substitutions, about 8 amino acid substitutions to about 115 amino acid substitutions, about 8 amino acid substitutions to about 110 amino acid substitutions, about 8 amino acid substitutions to about 105 amino acid substitutions, about 8 amino acid substitutions to about 100 amino acid substitutions, about 8 amino acid substitutions to about 95 amino acid substitutions, about 8 amino acid substitutions to about 90 amino acid substitutions, about 8 amino acid substitutions to about 85 amino acid substitutions, about 8 amino acid substitutions to about 80 amino acid substitutions, about 8 amino acid substitutions to about 75 amino acid substitutions, about 8 amino acid substitutions to about 70 amino acid substitutions, about 8 amino acid substitutions to about 65 amino acid substitutions, about 8 amino acid substitutions to about 60 amino acid substitutions, about 8 amino acid substitutions to about 55 amino acid substitutions, about 8 amino acid substitutions to about 50 amino acid substitutions, about 8 amino acid substitutions to about 45 amino acid substitutions, about 8 amino acid substitutions to about 40 amino acid substitutions, about 8 amino acid substitutions to about 35 amino acid substitutions, about 8 amino acid substitutions to about 30 amino acid substitutions, about 8 amino acid substitutions to about 25 amino acid substitutions, about 8 amino acid substitutions to about 20 amino acid substitutions, about 8 amino acid substitutions to about 15 amino acid substitutions, about 8 amino acid substitutions to about 10 amino acid substitutions, between about 10 amino acid substitutions to about 240 amino acid substitutions, about 10 amino acid substitutions to about 235 amino acid substitutions, about 10 amino acid substitutions to about 230 amino acid substitutions, about 10 amino acid substitutions to about 225 amino acid substitutions, about 10 amino acid substitutions substitution to about 220 amino acid substitutions, about 10 amino acid substitutions to about 215 amino acid substitutions, about 10 amino acid substitutions to about 210 amino acid substitutions, about 10 amino acid substitutions to about 205 amino acid substitutions, about 10 amino acid substitutions to about 200 amino acid substitutions, about 10 amino acid substitutions to about 195 amino acid substitutions, about 10 amino acid substitutions to about 190 amino acid substitutions, about 10 amino acid substitutions to about 185 amino acid substitutions, about 10 amino acid substitutions to about 180 amino acid substitutions, about 10 amino acid substitutions to about 175 amino acid substitutions, about 10 amino acid substitutions to about 170 amino acid substitutions, about 10 amino acid substitutions to about 165 amino acid substitutions, about 10 amino acid substitutions to about 160 amino acid substitutions, about 10 amino acid substitutions to about 155 amino acid substitutions, about 10 amino acid substitutions to about 150 amino acid substitutions, about 10 amino acid substitutions to about 145 amino acid substitutions, about 10 amino acid substitutions to about 140 amino acid substitutions, about 10 amino acid substitutions to about 135 amino acid substitutions, about 10 amino acid substitutions to about 130 amino acid substitutions, about 10 amino acid substitutions to about 125 amino acid substitutions, about 10 amino acid substitutions to about 120 amino acid substitutions, about 10 amino acid substitutions to about 115 amino acid substitutions, about 10 amino acid substitutions to about 110 amino acid substitutions, about 10 amino acid substitutions to about 105 amino acid substitutions, about 10 amino acid substitutions to about 100 amino acid substitutions, about 10 amino acid substitutions to about 95 amino acid substitutions, about 10 amino acid substitutions to about 90 amino acid substitutions, about 10 amino acid substitutions to about 85 amino acid substitutions, about 10 amino acid substitutions to about 80 amino acid substitutions, about 10 amino acid substitutions to about 75 amino acid substitutions, about 10 amino acid substitutions to about 70 amino acid substitutions, about 10 amino acid substitutions to about 65 amino acid substitutions, about 10 amino acid substitutions to about 60 amino acid substitutions, about 10 amino acid substitutions to about 55 amino acid substitutions, about 10 amino acid substitutions to about 50 amino acid substitutions, about 10 amino acid substitutions to about 45 amino acid substitutions, about 10 amino acid substitutions to about 40 amino acid substitutions, about 10 amino acid substitutions to about 35 amino acid substitutions, about 10 amino acid substitutions to about 30 amino acid substitutions, about 10 amino acid substitutions to about 25 amino acid substitutions, about 10 amino acid substitutions to about 20 amino acid substitutions, about 10 amino acid substitutions to about 15 amino acid substitutions, between about 15 amino acid substitutions to about 240 amino acid substitutions, about 15 amino acid substitutions to about 235 amino acid substitutions, about 15 amino acid substitutions to about 230 amino acid substitutions, about 15 amino acid substitutions to about 225 amino acid substitutions, about 15 amino acid substitutions substitution to about 220 amino acid substitutions, about 15 amino acid substitutions to about 215 amino acid substitutions, about 15 amino acid substitutions to about 210 amino acid substitutions, about 15 amino acid substitutions to about 205 amino acid substitutions, about 15 amino acid substitutions to about 200 amino acid substitutions, about 15 amino acid substitutions to about 195 amino acid substitutions, about 15 amino acid substitutions to about 190 amino acid substitutions, about 15 amino acid substitutions to about 185 amino acid substitutions, about 15 amino acid substitutions to about 180 amino acid substitutions, about 15 amino acid substitutions to about 175 amino acid substitutions, about 15 amino acid substitutions to about 170 amino acid substitutions, about 15 amino acid substitutions to about 165 amino acid substitutions, about 15 amino acid substitutions to about 160 amino acid substitutions, about 15 amino acid substitutions to about 155 amino acid substitutions, about 15 amino acid substitutions to about 150 amino acid substitutions, about 15 amino acid substitutions to about 145 amino acid substitutions, about 15 amino acid substitutions to about 140 amino acid substitutions, about 15 amino acid substitutions to about 135 amino acid substitutions, about 15 amino acid substitutions to about 130 amino acid substitutions, about 15 amino acid substitutions to about 125 amino acid substitutions, about 15 amino acid substitutions to about 120 amino acid substitutions, about 15 amino acid substitutions to about 115 amino acid substitutions, about 15 amino acid substitutions to about 110 amino acid substitutions, about 15 amino acid substitutions to about 105 amino acid substitutions, about 15 amino acid substitutions to about 100 amino acid substitutions, about 15 amino acid substitutions to about 95 amino acid substitutions, about 15 amino acid substitutions to about 90 amino acid substitutions, about 15 amino acid substitutions to about 85 amino acid substitutions, about 15 amino acid substitutions to about 80 amino acid substitutions, about 15 amino acid substitutions to about 75 amino acid substitutions, about 15 amino acid substitutions to about 70 amino acid substitutions, about 15 amino acid substitutions to about 65 amino acid substitutions, about 15 amino acid substitutions to about 60 amino acid substitutions, about 15 amino acid substitutions to about 55 amino acid substitutions, about 15 amino acid substitutions to about 50 amino acid substitutions, about 15 amino acid substitutions to about 45 amino acid substitutions, about 15 amino acid substitutions to about 40 amino acid substitutions, about 15 amino acid substitutions to about 35 amino acid substitutions, about 15 amino acid substitutions to about 30 amino acid substitutions, about 15 amino acid substitutions to about 25 amino acid substitutions, about 15 amino acid substitutions to about 20 amino acid substitutions, between about 20 amino acid substitutions to about 240 amino acid substitutions, about 20 amino acid substitutions to about 235 amino acid substitutions, about 20 amino acid substitutions to about 230 amino acid substitutions, about 20 amino acid substitutions to about 225 amino acid substitutions, about 20 amino acid substitutions substitution to about 220 amino acid substitutions, about 20 amino acid substitutions to about 215 amino acid substitutions, about 20 amino acid substitutions to about 210 amino acid substitutions, about 20 amino acid substitutions to about 205 amino acid substitutions, about 20 amino acid substitutions to about 200 amino acid substitutions, about 20 amino acid substitutions to about 195 amino acid substitutions, about 20 amino acid substitutions to about 190 amino acid substitutions, about 20 amino acid substitutions to about 185 amino acid substitutions, about 20 amino acid substitutions to about 180 amino acid substitutions, about 20 amino acid substitutions to about 175 amino acid substitutions, about 20 amino acid substitutions to about 170 amino acid substitutions, about 20 amino acid substitutions to about 165 amino acid substitutions, about 20 amino acid substitutions to about 160 amino acid substitutions, about 20 amino acid substitutions to about 155 amino acid substitutions, about 20 amino acid substitutions to about 150 amino acid substitutions, about 20 amino acid substitutions to about 145 amino acid substitutions, about 20 amino acid substitutions to about 140 amino acid substitutions, about 20 amino acid substitutions to about 135 amino acid substitutions, about 20 amino acid substitutions to about 130 amino acid substitutions, about 20 amino acid substitutions to about 125 amino acid substitutions, about 20 amino acid substitutions to about 120 amino acid substitutions, about 20 amino acid substitutions to about 115 amino acid substitutions, about 20 amino acid substitutions to about 110 amino acid substitutions, about 20 amino acid substitutions to about 105 amino acid substitutions, about 20 amino acid substitutions to about 100 amino acid substitutions, about 20 amino acid substitutions to about 95 amino acid substitutions, about 20 amino acid substitutions to about 90 amino acid substitutions, about 20 amino acid substitutions to about 85 amino acid substitutions, about 20 amino acid substitutions to about 80 amino acid substitutions, about 20 amino acid substitutions to about 75 amino acid substitutions, about 20 amino acid substitutions to about 70 amino acid substitutions, about 20 amino acid substitutions to about 65 amino acid substitutions, about 20 amino acid substitutions to about 60 amino acid substitutions, about 20 amino acid substitutions to about 55 amino acid substitutions, about 20 amino acid substitutions to about 50 amino acid substitutions, about 20 amino acid substitutions to about 45 amino acid substitutions, about 20 amino acid substitutions to about 40 amino acid substitutions, about 20 amino acid substitutions to about 35 amino acid substitutions, about 20 amino acid substitutions to about 30 amino acid substitutions, about 20 amino acid substitutions to about 25 amino acid substitutions, between about 25 amino acid substitutions to about 240 amino acid substitutions, about 25 amino acid substitutions to about 235 amino acid substitutions, about 25 amino acid substitutions to about 230 amino acid substitutions, about 25 amino acid substitutions to about 225 amino acid substitutions, about 25 amino acid substitutions substitution to about 220 amino acid substitutions, about 25 amino acid substitutions to about 215 amino acid substitutions, about 25 amino acid substitutions to about 210 amino acid substitutions, about 25 amino acid substitutions to about 205 amino acid substitutions, about 25 amino acid substitutions to about 200 amino acid substitutions, about 10 amino acid substitutions to about 195 amino acid substitutions, about 25 amino acid substitutions to about 190 amino acid substitutions, about 25 amino acid substitutions to about 185 amino acid substitutions, about 25 amino acid substitutions to about 180 amino acid substitutions, about 25 amino acid substitutions to about 175 amino acid substitutions, about 25 amino acid substitutions to about 170 amino acid substitutions, about 25 amino acid substitutions to about 165 amino acid substitutions, about 25 amino acid substitutions to about 160 amino acid substitutions, about 25 amino acid substitutions to about 155 amino acid substitutions, about 25 amino acid substitutions to about 150 amino acid substitutions, about 25 amino acid substitutions to about 145 amino acid substitutions, about 25 amino acid substitutions to about 140 amino acid substitutions, about 25 amino acid substitutions to about 135 amino acid substitutions, about 25 amino acid substitutions to about 130 amino acid substitutions, about 25 amino acid substitutions to about 125 amino acid substitutions, about 25 amino acid substitutions to about 120 amino acid substitutions, about 25 amino acid substitutions to about 115 amino acid substitutions, about 25 amino acid substitutions to about 110 amino acid substitutions, about 25 amino acid substitutions to about 105 amino acid substitutions, about 25 amino acid substitutions to about 100 amino acid substitutions, about 25 amino acid substitutions to about 95 amino acid substitutions, about 25 amino acid substitutions to about 90 amino acid substitutions, about 25 amino acid substitutions to about 85 amino acid substitutions, about 25 amino acid substitutions to about 80 amino acid substitutions, about 25 amino acid substitutions to about 75 amino acid substitutions, about 25 amino acid substitutions to about 70 amino acid substitutions, about 25 amino acid substitutions to about 65 amino acid substitutions, about 25 amino acid substitutions to about 60 amino acid substitutions, about 25 amino acid substitutions to about 55 amino acid substitutions, about 25 amino acid substitutions to about 50 amino acid substitutions, about 25 amino acid substitutions to about 45 amino acid substitutions, about 25 amino acid substitutions to about 40 amino acid substitutions, about 25 amino acid substitutions to about 35 amino acid substitutions, about 25 amino acid substitutions to about 30 amino acid substitutions, between about 30 amino acid substitutions to about 240 amino acid substitutions, about 30 amino acid substitutions to about 235 amino acid substitutions, about 30 amino acid substitutions to about 230 amino acid substitutions, about 30 amino acid substitutions to about 225 amino acid substitutions, about 30 amino acid substitutions substitution to about 220 amino acid substitutions, about 30 amino acid substitutions to about 215 amino acid substitutions, about 30 amino acid substitutions to about 210 amino acid substitutions, about 30 amino acid substitutions to about 205 amino acid substitutions, about 30 amino acid substitutions to about 200 amino acid substitutions, about 30 amino acid substitutions to about 195 amino acid substitutions, about 30 amino acid substitutions to about 190 amino acid substitutions, about 30 amino acid substitutions to about 185 amino acid substitutions, about 30 amino acid substitutions to about 180 amino acid substitutions, about 30 amino acid substitutions to about 175 amino acid substitutions, about 30 amino acid substitutions to about 170 amino acid substitutions, about 30 amino acid substitutions to about 165 amino acid substitutions, about 30 amino acid substitutions to about 160 amino acid substitutions, about 30 amino acid substitutions to about 155 amino acid substitutions, about 30 amino acid substitutions to about 150 amino acid substitutions, about 30 amino acid substitutions to about 145 amino acid substitutions, about 30 amino acid substitutions to about 140 amino acid substitutions, about 30 amino acid substitutions to about 135 amino acid substitutions, about 30 amino acid substitutions to about 130 amino acid substitutions, about 30 amino acid substitutions to about 125 amino acid substitutions, about 30 amino acid substitutions to about 120 amino acid substitutions, about 30 amino acid substitutions to about 115 amino acid substitutions, about 30 amino acid substitutions to about 110 amino acid substitutions, about 30 amino acid substitutions to about 105 amino acid substitutions, about 30 amino acid substitutions to about 100 amino acid substitutions, about 30 amino acid substitutions to about 95 amino acid substitutions, about 30 amino acid substitutions to about 90 amino acid substitutions, about 30 amino acid substitutions to about 85 amino acid substitutions, about 30 amino acid substitutions to about 80 amino acid substitutions, about 30 amino acid substitutions to about 75 amino acid substitutions, about 30 amino acid substitutions to about 70 amino acid substitutions, about 30 amino acid substitutions to about 65 amino acid substitutions, about 30 amino acid substitutions to about 60 amino acid substitutions, about 30 amino acid substitutions to about 55 amino acid substitutions, about 30 amino acid substitutions to about 50 amino acid substitutions, about 30 amino acid substitutions to about 45 amino acid substitutions, about 30 amino acid substitutions to about 40 amino acid substitutions, about 30 amino acid substitutions to about 35 amino acid substitutions, between about 35 amino acid substitutions to about 240 amino acid substitutions, about 35 amino acid substitutions to about 235 amino acid substitutions, about 35 amino acid substitutions to about 230 amino acid substitutions, about 35 amino acid substitutions to about 225 amino acid substitutions, about 35 amino acid substitutions substitution to about 220 amino acid substitutions, about 35 amino acid substitutions to about 215 amino acid substitutions, about 35 amino acid substitutions to about 210 amino acid substitutions, about 35 amino acid substitutions to about 205 amino acid substitutions, about 35 amino acid substitutions to about 200 amino acid substitutions, about 35 amino acid substitutions to about 195 amino acid substitutions, about 35 amino acid substitutions to about 190 amino acid substitutions, about 35 amino acid substitutions to about 185 amino acid substitutions, about 35 amino acid substitutions to about 180 amino acid substitutions, about 35 amino acid substitutions to about 175 amino acid substitutions, about 35 amino acid substitutions to about 170 amino acid substitutions, about 35 amino acid substitutions to about 165 amino acid substitutions, about 35 amino acid substitutions to about 160 amino acid substitutions, about 35 amino acid substitutions to about 155 amino acid substitutions, about 35 amino acid substitutions to about 150 amino acid substitutions, about 35 amino acid substitutions to about 145 amino acid substitutions, about 35 amino acid substitutions to about 140 amino acid substitutions, about 35 amino acid substitutions to about 135 amino acid substitutions, about 35 amino acid substitutions to about 130 amino acid substitutions, about 35 amino acid substitutions to about 125 amino acid substitutions, about 35 amino acid substitutions to about 120 amino acid substitutions, about 35 amino acid substitutions to about 115 amino acid substitutions, about 35 amino acid substitutions to about 110 amino acid substitutions, about 35 amino acid substitutions to about 105 amino acid substitutions, about 35 amino acid substitutions to about 100 amino acid substitutions, about 35 amino acid substitutions to about 95 amino acid substitutions, about 35 amino acid substitutions to about 90 amino acid substitutions, about 35 amino acid substitutions to about 85 amino acid substitutions, about 35 amino acid substitutions to about 80 amino acid substitutions, about 35 amino acid substitutions to about 75 amino acid substitutions, about 35 amino acid substitutions to about 70 amino acid substitutions, about 35 amino acid substitutions to about 65 amino acid substitutions, about 35 amino acid substitutions to about 60 amino acid substitutions, about 35 amino acid substitutions to about 55 amino acid substitutions, about 35 amino acid substitutions to about 50 amino acid substitutions, about 35 amino acid substitutions to about 45 amino acid substitutions, about 35 amino acid substitutions to about 40 amino acid substitutions, between about 40 amino acid substitutions to about 240 amino acid substitutions, about 40 amino acid substitutions to about 235 amino acid substitutions, about 40 amino acid substitutions to about 230 amino acid substitutions, about 40 amino acid substitutions to about 225 amino acid substitutions, about 40 amino acid substitutions substitution to about 220 amino acid substitutions, about 40 amino acid substitutions to about 215 amino acid substitutions, about 40 amino acid substitutions to about 210 amino acid substitutions, about 40 amino acid substitutions to about 205 amino acid substitutions, about 40 amino acid substitutions to about 200 amino acid substitutions, about 40 amino acid substitutions to about 195 amino acid substitutions, about 40 amino acid substitutions to about 190 amino acid substitutions, about 40 amino acid substitutions to about 185 amino acid substitutions, about 40 amino acid substitutions to about 180 amino acid substitutions, about 40 amino acid substitutions to about 175 amino acid substitutions, about 40 amino acid substitutions to about 170 amino acid substitutions, about 40 amino acid substitutions to about 165 amino acid substitutions, about 40 amino acid substitutions to about 160 amino acid substitutions, about 40 amino acid substitutions to about 155 amino acid substitutions, about 40 amino acid substitutions to about 150 amino acid substitutions, about 40 amino acid substitutions to about 145 amino acid substitutions, about 40 amino acid substitutions to about 140 amino acid substitutions, about 40 amino acid substitutions to about 135 amino acid substitutions, about 40 amino acid substitutions to about 130 amino acid substitutions, about 40 amino acid substitutions to about 125 amino acid substitutions, about 40 amino acid substitutions to about 120 amino acid substitutions, about 40 amino acid substitutions to about 115 amino acid substitutions, about 40 amino acid substitutions to about 110 amino acid substitutions, about 40 amino acid substitutions to about 105 amino acid substitutions, about 40 amino acid substitutions to about 100 amino acid substitutions, about 40 amino acid substitutions to about 95 amino acid substitutions, about 40 amino acid substitutions to about 90 amino acid substitutions, about 40 amino acid substitutions to about 85 amino acid substitutions, about 40 amino acid substitutions to about 80 amino acid substitutions, about 40 amino acid substitutions to about 75 amino acid substitutions, about 40 amino acid substitutions to about 70 amino acid substitutions, about 40 amino acid substitutions to about 65 amino acid substitutions, about 40 amino acid substitutions to about 60 amino acid substitutions, about 40 amino acid substitutions to about 55 amino acid substitutions, about 40 amino acid substitutions to about 50 amino acid substitutions, about 40 amino acid substitutions to about 45 amino acid substitutions, between about 45 amino acid substitutions to about 240 amino acid substitutions, about 45 amino acid substitutions to about 235 amino acid substitutions, about 45 amino acid substitutions to about 230 amino acid substitutions, about 45 amino acid substitutions to about 225 amino acid substitutions, about 45 amino acid substitutions substitution to about 220 amino acid substitutions, about 45 amino acid substitutions to about 215 amino acid substitutions, about 45 amino acid substitutions to about 210 amino acid substitutions, about 45 amino acid substitutions to about 205 amino acid substitutions, about 45 amino acid substitutions to about 200 amino acid substitutions, about 45 amino acid substitutions to about 195 amino acid substitutions, about 45 amino acid substitutions to about 190 amino acid substitutions, about 45 amino acid substitutions to about 185 amino acid substitutions, about 45 amino acid substitutions to about 180 amino acid substitutions, about 45 amino acid substitutions to about 175 amino acid substitutions, about 45 amino acid substitutions to about 170 amino acid substitutions, about 45 amino acid substitutions to about 165 amino acid substitutions, about 45 amino acid substitutions to about 160 amino acid substitutions, about 45 amino acid substitutions to about 155 amino acid substitutions, about 45 amino acid substitutions to about 150 amino acid substitutions, about 45 amino acid substitutions to about 145 amino acid substitutions, about 45 amino acid substitutions to about 140 amino acid substitutions, about 45 amino acid substitutions to about 135 amino acid substitutions, about 45 amino acid substitutions to about 130 amino acid substitutions, about 45 amino acid substitutions to about 125 amino acid substitutions, about 45 amino acid substitutions to about 120 amino acid substitutions, about 45 amino acid substitutions to about 115 amino acid substitutions, about 45 amino acid substitutions to about 110 amino acid substitutions, about 45 amino acid substitutions to about 105 amino acid substitutions, about 45 amino acid substitutions to about 100 amino acid substitutions, about 45 amino acid substitutions to about 95 amino acid substitutions, about 45 amino acid substitutions to about 90 amino acid substitutions, about 45 amino acid substitutions to about 85 amino acid substitutions, about 45 amino acid substitutions to about 80 amino acid substitutions, about 45 amino acid substitutions to about 75 amino acid substitutions, about 45 amino acid substitutions to about 70 amino acid substitutions, about 45 amino acid substitutions to about 65 amino acid substitutions, about 45 amino acid substitutions to about 60 amino acid substitutions, about 45 amino acid substitutions to about 55 amino acid substitutions, about 45 amino acid substitutions to about 50 amino acid substitutions, between about 50 amino acid substitutions to about 240 amino acid substitutions, about 50 amino acid substitutions to about 235 amino acid substitutions, about 50 amino acid substitutions to about 230 amino acid substitutions, about 50 amino acid substitutions to about 225 amino acid substitutions, about 50 amino acid substitutions substitution to about 220 amino acid substitutions, about 50 amino acid substitutions to about 215 amino acid substitutions, about 50 amino acid substitutions to about 210 amino acid substitutions, about 50 amino acid substitutions to about 205 amino acid substitutions, about 50 amino acid substitutions to about 200 amino acid substitutions, about 50 amino acid substitutions to about 195 amino acid substitutions, about 50 amino acid substitutions to about 190 amino acid substitutions, about 50 amino acid substitutions to about 185 amino acid substitutions, about 50 amino acid substitutions to about 180 amino acid substitutions, about 50 amino acid substitutions to about 175 amino acid substitutions, about 50 amino acid substitutions to about 170 amino acid substitutions, about 50 amino acid substitutions to about 165 amino acid substitutions, about 50 amino acid substitutions to about 160 amino acid substitutions, about 50 amino acid substitutions to about 155 amino acid substitutions, about 50 amino acid substitutions to about 150 amino acid substitutions, about 50 amino acid substitutions to about 145 amino acid substitutions, about 50 amino acid substitutions to about 140 amino acid substitutions, about 50 amino acid substitutions to about 135 amino acid substitutions, about 50 amino acid substitutions to about 130 amino acid substitutions, about 50 amino acid substitutions to about 125 amino acid substitutions, about 50 amino acid substitutions to about 120 amino acid substitutions, about 50 amino acid substitutions to about 115 amino acid substitutions, about 50 amino acid substitutions to about 110 amino acid substitutions, about 50 amino acid substitutions to about 105 amino acid substitutions, about 50 amino acid substitutions to about 100 amino acid substitutions, about 50 amino acid substitutions to about 95 amino acid substitutions, about 50 amino acid substitutions to about 90 amino acid substitutions, about 50 amino acid substitutions to about 85 amino acid substitutions, about 50 amino acid substitutions to about 80 amino acid substitutions, about 50 amino acid substitutions to about 75 amino acid substitutions, about 50 amino acid substitutions to about 70 amino acid substitutions, about 50 amino acid substitutions to about 65 amino acid substitutions, about 50 amino acid substitutions to about 60 amino acid substitutions, about 50 amino acid substitutions to about 55 amino acid substitutions, between about 60 amino acid substitutions to about 240 amino acid substitutions, about 60 amino acid substitutions to about 235 amino acid substitutions, about 60 amino acid substitutions to about 230 amino acid substitutions, about 60 amino acid substitutions to about 225 amino acid substitutions, about 60 amino acid substitutions substitution to about 220 amino acid substitutions, about 60 amino acid substitutions to about 215 amino acid substitutions, about 60 amino acid substitutions to about 210 amino acid substitutions, about 60 amino acid substitutions to about 205 amino acid substitutions, about 60 amino acid substitutions to about 200 amino acid substitutions, about 60 amino acid substitutions to about 195 amino acid substitutions, about 60 amino acid substitutions to about 190 amino acid substitutions, about 60 amino acid substitutions to about 185 amino acid substitutions, about 60 amino acid substitutions to about 180 amino acid substitutions, about 60 amino acid substitutions to about 175 amino acid substitutions, about 60 amino acid substitutions to about 170 amino acid substitutions, about 60 amino acid substitutions to about 165 amino acid substitutions, about 60 amino acid substitutions to about 160 amino acid substitutions, about 60 amino acid substitutions to about 155 amino acid substitutions, about 60 amino acid substitutions to about 150 amino acid substitutions, about 60 amino acid substitutions to about 145 amino acid substitutions, about 60 amino acid substitutions to about 140 amino acid substitutions, about 60 amino acid substitutions to about 135 amino acid substitutions, about 60 amino acid substitutions to about 130 amino acid substitutions, about 60 amino acid substitutions to about 125 amino acid substitutions, about 60 amino acid substitutions to about 120 amino acid substitutions, about 60 amino acid substitutions to about 115 amino acid substitutions, about 60 amino acid substitutions to about 110 amino acid substitutions, about 60 amino acid substitutions to about 105 amino acid substitutions, about 60 amino acid substitutions to about 100 amino acid substitutions, about 60 amino acid substitutions to about 95 amino acid substitutions, about 60 amino acid substitutions to about 90 amino acid substitutions, about 60 amino acid substitutions to about 85 amino acid substitutions, about 60 amino acid substitutions to about 80 amino acid substitutions, about 60 amino acid substitutions to about 75 amino acid substitutions, about 60 amino acid substitutions to about 70 amino acid substitutions, about 60 amino acid substitutions to about 65 amino acid substitutions, between about 70 amino acid substitutions to about 240 amino acid substitutions, about 70 amino acid substitutions to about 235 amino acid substitutions, about 70 amino acid substitutions to about 230 amino acid substitutions, about 70 amino acid substitutions to about 225 amino acid substitutions, about 70 amino acid substitutions substitution to about 220 amino acid substitutions, about 70 amino acid substitutions to about 215 amino acid substitutions, about 70 amino acid substitutions to about 210 amino acid substitutions, about 10 amino acid substitutions to about 205 amino acid substitutions, about 70 amino acid substitutions to about 200 amino acid substitutions, about 70 amino acid substitutions to about 195 amino acid substitutions, about 70 amino acid substitutions to about 190 amino acid substitutions, about 70 amino acid substitutions to about 185 amino acid substitutions, about 70 amino acid substitutions to about 180 amino acid substitutions, about 70 amino acid substitutions to about 175 amino acid substitutions, about 70 amino acid substitutions to about 170 amino acid substitutions, about 70 amino acid substitutions to about 165 amino acid substitutions, about 70 amino acid substitutions to about 160 amino acid substitutions, about 70 amino acid substitutions to about 155 amino acid substitutions, about 70 amino acid substitutions to about 150 amino acid substitutions, about 70 amino acid substitutions to about 145 amino acid substitutions, about 70 amino acid substitutions to about 140 amino acid substitutions, about 70 amino acid substitutions to about 135 amino acid substitutions, about 70 amino acid substitutions to about 130 amino acid substitutions, about 70 amino acid substitutions to about 125 amino acid substitutions, about 70 amino acid substitutions to about 120 amino acid substitutions, about 70 amino acid substitutions to about 115 amino acid substitutions, about 70 amino acid substitutions to about 110 amino acid substitutions, about 70 amino acid substitutions to about 105 amino acid substitutions, about 70 amino acid substitutions to about 100 amino acid substitutions, about 70 amino acid substitutions to about 95 amino acid substitutions, about 70 amino acid substitutions to about 90 amino acid substitutions, about 70 amino acid substitutions to about 85 amino acid substitutions, about 70 amino acid substitutions to about 80 amino acid substitutions, about 70 amino acid substitutions to about 75 amino acid substitutions, between about 80 amino acid substitutions to about 240 amino acid substitutions, about 80 amino acid substitutions to about 235 amino acid substitutions, about 80 amino acid substitutions to about 230 amino acid substitutions, about 80 amino acid substitutions to about 225 amino acid substitutions, about 80 amino acid substitutions substitution to about 220 amino acid substitutions, about 80 amino acid substitutions to about 215 amino acid substitutions, about 80 amino acid substitutions to about 210 amino acid substitutions, about 80 amino acid substitutions to about 205 amino acid substitutions, about 80 amino acid substitutions to about 200 amino acid substitutions, about 80 amino acid substitutions to about 195 amino acid substitutions, about 80 amino acid substitutions to about 190 amino acid substitutions, about 80 amino acid substitutions to about 185 amino acid substitutions, about 80 amino acid substitutions to about 180 amino acid substitutions, about 80 amino acid substitutions to about 175 amino acid substitutions, about 80 amino acid substitutions to about 170 amino acid substitutions, about 80 amino acid substitutions to about 165 amino acid substitutions, about 80 amino acid substitutions to about 160 amino acid substitutions, about 80 amino acid substitutions to about 155 amino acid substitutions, about 80 amino acid substitutions to about 150 amino acid substitutions, about 80 amino acid substitutions to about 145 amino acid substitutions, about 80 amino acid substitutions to about 140 amino acid substitutions, about 80 amino acid substitutions to about 135 amino acid substitutions, about 80 amino acid substitutions to about 130 amino acid substitutions, about 80 amino acid substitutions to about 125 amino acid substitutions, about 80 amino acid substitutions to about 120 amino acid substitutions, about 80 amino acid substitutions to about 115 amino acid substitutions, about 80 amino acid substitutions to about 110 amino acid substitutions, about 80 amino acid substitutions to about 105 amino acid substitutions, about 80 amino acid substitutions to about 100 amino acid substitutions, about 80 amino acid substitutions to about 95 amino acid substitutions, about 80 amino acid substitutions to about 90 amino acid substitutions, about 80 amino acid substitutions to about 85 amino acid substitutions, between about 90 amino acid substitutions to about 240 amino acid substitutions, about 90 amino acid substitutions to about 235 amino acid substitutions, about 90 amino acid substitutions to about 230 amino acid substitutions, about 90 amino acid substitutions to about 225 amino acid substitutions, about 90 amino acid substitutions substitution to about 220 amino acid substitutions, about 90 amino acid substitutions to about 215 amino acid substitutions, about 90 amino acid substitutions to about 210 amino acid substitutions, about 90 amino acid substitutions to about 205 amino acid substitutions, about 90 amino acid substitutions to about 200 amino acid substitutions, about 90 amino acid substitutions to about 195 amino acid substitutions, about 90 amino acid substitutions to about 190 amino acid substitutions, about 90 amino acid substitutions to about 185 amino acid substitutions, about 90 amino acid substitutions to about 180 amino acid substitutions, about 90 amino acid substitutions to about 175 amino acid substitutions, about 90 amino acid substitutions to about 170 amino acid substitutions, about 90 amino acid substitutions to about 165 amino acid substitutions, about 90 amino acid substitutions to about 160 amino acid substitutions, about 90 amino acid substitutions to about 155 amino acid substitutions, about 90 amino acid substitutions to about 150 amino acid substitutions, about 90 amino acid substitutions to about 145 amino acid substitutions, about 90 amino acid substitutions to about 140 amino acid substitutions, about 90 amino acid substitutions to about 135 amino acid substitutions, about 90 amino acid substitutions to about 130 amino acid substitutions, about 90 amino acid substitutions to about 125 amino acid substitutions, about 90 amino acid substitutions to about 120 amino acid substitutions, about 90 amino acid substitutions to about 115 amino acid substitutions, about 90 amino acid substitutions to about 110 amino acid substitutions, about 90 amino acid substitutions to about 105 amino acid substitutions, about 90 amino acid substitutions to about 100 amino acid substitutions, about 90 amino acid substitutions to about 95 amino acid substitutions, between about 100 amino acid substitutions to about 240 amino acid substitutions, about 100 amino acid substitutions to about 235 amino acid substitutions, about 100 amino acid substitutions to about 230 amino acid substitutions, about 100 amino acid substitutions to about 225 amino acid substitutions, about 100 amino acid substitutions substitution to about 220 amino acid substitutions, about 100 amino acid substitutions to about 215 amino acid substitutions, about 100 amino acid substitutions to about 210 amino acid substitutions, about 100 amino acid substitutions to about 205 amino acid substitutions, about 100 amino acid substitutions to about 200 amino acid substitutions, about 100 amino acid substitutions to about 195 amino acid substitutions, about 100 amino acid substitutions to about 190 amino acid substitutions, about 100 amino acid substitutions to about 185 amino acid substitutions, about 100 amino acid substitutions to about 180 amino acid substitutions, about 100 amino acid substitutions to about 175 amino acid substitutions, about 100 amino acid substitutions to about 170 amino acid substitutions, about 100 amino acid substitutions to about 165 amino acid substitutions, about 100 amino acid substitutions to about 160 amino acid substitutions, about 100 amino acid substitutions to about 155 amino acid substitutions, about 100 amino acid substitutions to about 150 amino acid substitutions, about 100 amino acid substitutions to about 145 amino acid substitutions, about 100 amino acid substitutions to about 140 amino acid substitutions, about 100 amino acid substitutions to about 135 amino acid substitutions, about 100 amino acid substitutions to about 130 amino acid substitutions, about 100 amino acid substitutions to about 125 amino acid substitutions, about 100 amino acid substitutions to about 120 amino acid substitutions, about 100 amino acid substitutions to about 115 amino acid substitutions, about 100 amino acid substitutions to about 110 amino acid substitutions, about 100 amino acid substitutions to about 105 amino acid substitutions, between about 110 amino acid substitutions to about 240 amino acid substitutions, about 110 amino acid substitutions to about 235 amino acid substitutions, about 110 amino acid substitutions to about 230 amino acid substitutions, about 110 amino acid substitutions to about 225 amino acid substitutions, about 110 amino acid substitutions substitution to about 220 amino acid substitutions, about 110 amino acid substitutions to about 215 amino acid substitutions, about 110 amino acid substitutions to about 210 amino acid substitutions, about 110 amino acid substitutions to about 205 amino acid substitutions, about 110 amino acid substitutions to about 200 amino acid substitutions, about 110 amino acid substitutions to about 195 amino acid substitutions, about 110 amino acid substitutions to about 190 amino acid substitutions, about 110 amino acid substitutions to about 185 amino acid substitutions, about 110 amino acid substitutions to about 180 amino acid substitutions, about 110 amino acid substitutions to about 175 amino acid substitutions, about 110 amino acid substitutions to about 170 amino acid substitutions, about 110 amino acid substitutions to about 165 amino acid substitutions, about 110 amino acid substitutions to about 160 amino acid substitutions, about 110 amino acid substitutions to about 155 amino acid substitutions, about 110 amino acid substitutions to about 150 amino acid substitutions, about 110 amino acid substitutions to about 145 amino acid substitutions, about 110 amino acid substitutions to about 140 amino acid substitutions, about 110 amino acid substitutions to about 135 amino acid substitutions, about 110 amino acid substitutions to about 130 amino acid substitutions, about 110 amino acid substitutions to about 125 amino acid substitutions, about 110 amino acid substitutions to about 120 amino acid substitutions, about 110 amino acid substitutions to about 115 amino acid substitutions, between about 120 amino acid substitutions to about 240 amino acid substitutions, about 120 amino acid substitutions to about 235 amino acid substitutions, about 120 amino acid substitutions to about 230 amino acid substitutions, about 120 amino acid substitutions to about 225 amino acid substitutions, about 120 amino acid substitutions substitution to about 220 amino acid substitutions, about 120 amino acid substitutions to about 215 amino acid substitutions, about 120 amino acid substitutions to about 210 amino acid substitutions, about 120 amino acid substitutions to about 205 amino acid substitutions, about 120 amino acid substitutions to about 200 amino acid substitutions, about 120 amino acid substitutions to about 195 amino acid substitutions, about 120 amino acid substitutions to about 190 amino acid substitutions, about 120 amino acid substitutions to about 185 amino acid substitutions, about 120 amino acid substitutions to about 180 amino acid substitutions, about 120 amino acid substitutions to about 175 amino acid substitutions, about 120 amino acid substitutions to about 170 amino acid substitutions, about 100 amino acid substitutions to about 165 amino acid substitutions, about 120 amino acid substitutions to about 160 amino acid substitutions, about 120 amino acid substitutions to about 155 amino acid substitutions, about 120 amino acid substitutions to about 150 amino acid substitutions, about 120 amino acid substitutions to about 145 amino acid substitutions, about 120 amino acid substitutions to about 140 amino acid substitutions, about 120 amino acid substitutions to about 135 amino acid substitutions, about 120 amino acid substitutions to about 130 amino acid substitutions, about 120 amino acid substitutions to about 125 amino acid substitutions, between about 130 amino acid substitutions to about 240 amino acid substitutions, about 130 amino acid substitutions to about 235 amino acid substitutions, about 130 amino acid substitutions to about 230 amino acid substitutions, about 130 amino acid substitutions to about 225 amino acid substitutions, about 130 amino acid substitutions substitution to about 220 amino acid substitutions, about 130 amino acid substitutions to about 215 amino acid substitutions, about 130 amino acid substitutions to about 210 amino acid substitutions, about 130 amino acid substitutions to about 205 amino acid substitutions, about 130 amino acid substitutions to about 200 amino acid substitutions, about 130 amino acid substitutions to about 195 amino acid substitutions, about 130 amino acid substitutions to about 190 amino acid substitutions, about 130 amino acid substitutions to about 185 amino acid substitutions, about 130 amino acid substitutions to about 180 amino acid substitutions, about 130 amino acid substitutions to about 175 amino acid substitutions, about 130 amino acid substitutions to about 170 amino acid substitutions, about 130 amino acid substitutions to about 165 amino acid substitutions, about 130 amino acid substitutions to about 160 amino acid substitutions, about 130 amino acid substitutions to about 155 amino acid substitutions, about 130 amino acid substitutions to about 150 amino acid substitutions, about 130 amino acid substitutions to about 145 amino acid substitutions, about 130 amino acid substitutions to about 140 amino acid substitutions, about 130 amino acid substitutions to about 135 amino acid substitutions, between about 140 amino acid substitutions to about 240 amino acid substitutions, about 140 amino acid substitutions to about 235 amino acid substitutions, about 140 amino acid substitutions to about 230 amino acid substitutions, about 140 amino acid substitutions to about 225 amino acid substitutions, about 140 amino acid substitutions substitution to about 220 amino acid substitutions, about 140 amino acid substitutions to about 215 amino acid substitutions, about 140 amino acid substitutions to about 210 amino acid substitutions, about 140 amino acid substitutions to about 205 amino acid substitutions, about 140 amino acid substitutions to about 200 amino acid substitutions, about 140 amino acid substitutions to about 195 amino acid substitutions, about 140 amino acid substitutions to about 190 amino acid substitutions, about 140 amino acid substitutions to about 185 amino acid substitutions, about 140 amino acid substitutions to about 180 amino acid substitutions, about 140 amino acid substitutions to about 175 amino acid substitutions, about 140 amino acid substitutions to about 170 amino acid substitutions, about 140 amino acid substitutions to about 165 amino acid substitutions, about 140 amino acid substitutions to about 160 amino acid substitutions, about 140 amino acid substitutions to about 155 amino acid substitutions, about 140 amino acid substitutions to about 150 amino acid substitutions, about 140 amino acid substitutions to about 145 amino acid substitutions, between about 150 amino acid substitutions to about 240 amino acid substitutions, about 150 amino acid substitutions to about 235 amino acid substitutions, about 150 amino acid substitutions to about 230 amino acid substitutions, about 150 amino acid substitutions to about 225 amino acid substitutions, about 150 amino acid substitutions substitution to about 220 amino acid substitutions, about 150 amino acid substitutions to about 215 amino acid substitutions, about 150 amino acid substitutions to about 210 amino acid substitutions, about 150 amino acid substitutions to about 205 amino acid substitutions, about 150 amino acid substitutions to about 200 amino acid substitutions, about 150 amino acid substitutions to about 195 amino acid substitutions, about 150 amino acid substitutions to about 190 amino acid substitutions, about 150 amino acid substitutions to about 185 amino acid substitutions, about 150 amino acid substitutions to about 180 amino acid substitutions, about 150 amino acid substitutions to about 175 amino acid substitutions, about 150 amino acid substitutions to about 170 amino acid substitutions, about 150 amino acid substitutions to about 165 amino acid substitutions, about 150 amino acid substitutions to about 160 amino acid substitutions, or about 150 amino acid substitutions to about 155 amino acid substitutions, between about 160 amino acid substitutions to about 240 amino acid substitutions, about 160 amino acid substitutions to about 235 amino acid substitutions, about 160 amino acid substitutions to about 230 amino acid substitutions, about 160 amino acid substitutions to about 225 amino acid substitutions, about 160 amino acid substitutions substitution to about 220 amino acid substitutions, about 160 amino acid substitutions to about 215 amino acid substitutions, about 160 amino acid substitutions to about 210 amino acid substitutions, about 160 amino acid substitutions to about 205 amino acid substitutions, about 160 amino acid substitutions to about 200 amino acid substitutions, about 160 amino acid substitutions to about 195 amino acid substitutions, about 160 amino acid substitutions to about 190 amino acid substitutions, about 160 amino acid substitutions to about 185 amino acid substitutions, about 160 amino acid substitutions to about 180 amino acid substitutions, about 160 amino acid substitutions to about 175 amino acid substitutions, about 160 amino acid substitutions to about 170 amino acid substitutions, about 160 amino acid substitutions to about 165 amino acid substitutions, between about 170 amino acid substitutions to about 240 amino acid substitutions, about 170 amino acid substitutions to about 235 amino acid substitutions, about 170 amino acid substitutions to about 230 amino acid substitutions, about 170 amino acid substitutions to about 225 amino acid substitutions, about 170 amino acid substitutions substitution to about 220 amino acid substitutions, about 170 amino acid substitutions to about 215 amino acid substitutions, about 170 amino acid substitutions to about 210 amino acid substitutions, about 170 amino acid substitutions to about 205 amino acid substitutions, about 170 amino acid substitutions to about 200 amino acid substitutions, about 170 amino acid substitutions to about 195 amino acid substitutions, about 170 amino acid substitutions to about 190 amino acid substitutions, about 170 amino acid substitutions to about 185 amino acid substitutions, about 170 amino acid substitutions to about 180 amino acid substitutions, about 170 amino acid substitutions to about 175 amino acid substitutions, between about 180 amino acid substitutions to about 240 amino acid substitutions, about 180 amino acid substitutions to about 235 amino acid substitutions, about 180 amino acid substitutions to about 230 amino acid substitutions, about 180 amino acid substitutions to about 225 amino acid substitutions, about 180 amino acid substitutions substitution to about 220 amino acid substitutions, about 180 amino acid substitutions to about 215 amino acid substitutions, about 180 amino acid substitutions to about 210 amino acid substitutions, about 180 amino acid substitutions to about 205 amino acid substitutions, about 180 amino acid substitutions to about 200 amino acid substitutions, about 180 amino acid substitutions to about 195 amino acid substitutions, about 180 amino acid substitutions to about 190 amino acid substitutions, about 180 amino acid substitutions to about 185 amino acid substitutions, between about 190 amino acid substitutions to about 240 amino acid substitutions, about 190 amino acid substitutions to about 235 amino acid substitutions, about 190 amino acid substitutions to about 230 amino acid substitutions, about 190 amino acid substitutions to about 225 amino acid substitutions, about 190 amino acid substitutions substitution to about 220 amino acid substitutions, about 190 amino acid substitutions to about 215 amino acid substitutions, about 190 amino acid substitutions to about 210 amino acid substitutions, about 190 amino acid substitutions to about 205 amino acid substitutions, about 190 amino acid substitutions to about 200 amino acid substitutions, about 190 amino acid substitutions to about 195 amino acid substitutions, between about 200 amino acid substitutions to about 240 amino acid substitutions, about 200 amino acid substitutions to about 235 amino acid substitutions, about 200 amino acid substitutions to about 230 amino acid substitutions, about 200 amino acid substitutions to about 225 amino acid substitutions, about 200 amino acid substitutions substitution to about 220 amino acid substitutions, about 200 amino acid substitutions to about 215 amino acid substitutions, about 200 amino acid substitutions to about 210 amino acid substitutions, about 200 amino acid substitutions to about 205 amino acid substitutions, between about 205 amino acid substitutions to about 240 amino acid substitutions, about 205 amino acid substitutions to about 235 amino acid substitutions, about 205 amino acid substitutions to about 230 amino acid substitutions, about 205 amino acid substitutions to about 225 amino acid substitutions, about 205 amino acid substitutions substitution to about 220 amino acid substitutions, about 205 amino acid substitutions to about 215 amino acid substitutions, about 205 amino acid substitutions to about 210 amino acid substitutions, between about 210 amino acid substitutions to about 240 amino acid substitutions, about 210 amino acid substitutions to about 235 amino acid substitutions, about 210 amino acid substitutions to about 230 amino acid substitutions, about 210 amino acid substitutions to about 225 amino acid substitutions, about 210 amino acid substitutions substitution to about 220 amino acid substitutions, about 210 amino acid substitutions to about 215 amino acid substitutions, between about 215 amino acid substitutions to about 240 amino acid substitutions, about 215 amino acid substitutions to about 235 amino acid substitutions, about 215 amino acid substitutions to about 230 amino acid substitutions, about 215 amino acid substitutions to about 225 amino acid substitutions, about 215 amino acid substitutions substitution to about 220 amino acid substitutions, between about 220 amino acid substitutions to about 240 amino acid substitutions, about 220 amino acid substitutions to about 235 amino acid substitutions, about 220 amino acid substitutions to about 230 amino acid substitutions, about 220 amino acid substitutions to about 225 amino acid substitutions, between about 225 amino acid substitutions to about 240 amino acid substitutions, about 225 amino acid substitutions to about 235 amino acid substitutions, about 225 amino acid substitutions to about 230 amino acid substitutions, between about 230 amino acid substitutions to about 240 amino acid substitutions, about 230 amino acid substitutions to about 235 amino acid substitutions. One skilled in the art would appreciate that amino acids that are not conserved between wildtype otoferlin proteins from different species can be mutated without losing activity, while those amino acids that are conserved between wildtype otoferlin proteins from different species should not be mutated as they are more likely (than amino acids that are not conserved between different species) to be involved in activity.

An active otoferlin protein can include, e.g., a sequence of a wildtype, full-length otoferlin protein (e.g., a wildtype, human, full-length otoferlin protein) that has 1 amino acid to about 200 amino acids, 1 amino acid to about 195 amino acids, 1 amino acid to about 190 amino acids, 1 amino acid to about 185 amino acids, 1 amino acid to about 180 amino acids, 1 amino acid to about 175 amino acids, 1 amino acid to about 170 amino acids, 1 amino acid to about 165 amino acids, 1 amino acid to about 160 amino acids, 1 amino acid to about 155 amino acids, 1 amino acid to about 150 amino acids, 1 amino acid to about 145 amino acids, 1 amino acid to about 140 amino acids, 1 amino acid to about 135 amino acids, 1 amino acid to about 130 amino acids, 1 amino acid to about 125 amino acids, 1 amino acid to about 120 amino acids, 1 amino acid to about 115 amino acids, 1 amino acid to about 110 amino acids, 1 amino acid to about 105 amino acids, 1 amino acid to about 100 amino acids, 1 amino acid to about 95 amino acids, 1 amino acid to about 90 amino acids, 1 amino acid to about 85 amino acids, 1 amino acid to about 80 amino acids, 1 amino acid to about 75 amino acids, 1 amino acid to about 70 amino acids, 1 amino acid to about 65 amino acids, 1 amino acid to about 60 amino acids, 1 amino acid to about 55 amino acids, 1 amino acid to about 50 amino acids, 1 amino acid to about 45 amino acids, 1 amino acid to about 40 amino acids, 1 amino acid to about 35 amino acids, 1 amino acid to about 30 amino acids, 1 amino acid to about 25 amino acids, 1 amino acid to about 20 amino acids, 1 amino acid to about 15 amino acids, 1 amino acid to about 10 amino acids, 1 amino acid to about 9 amino acids, 1 amino acid to about 8 amino acids, 1 amino acid to about 7 amino acids, 1 amino acid to about 6 amino acids, 1 amino acid to about 5 amino acids, 1 amino acid to about 4 amino acids, 1 amino acid to about 3 amino acids, about 2 amino acids to about 200 amino acids, about 2 amino acids to about 195 amino acids, about 2 amino acids to about 190 amino acids, about 2 amino acids to about 185 amino acids, about 2 amino acids to about 180 amino acids, about 2 amino acids to about 175 amino acids, about 2 amino acids to about 170 amino acids, about 2 amino acids to about 165 amino acids, about 2 amino acids to about 160 amino acids, about 2 amino acids to about 155 amino acids, about 2 amino acids to about 150 amino acids, about 2 amino acids to about 145 amino acids, about 2 amino acids to about 140 amino acids, about 2 amino acids to about 135 amino acids, about 2 amino acids to about 130 amino acids, about 2 amino acids to about 125 amino acids, about 2 amino acids to about 120 amino acids, about 2 amino acids to about 115 amino acids, about 2 amino acids to about 110 amino acids, about 2 amino acids to about 105 amino acids, about 2 amino acids to about 100 amino acids, about 2 amino acids to about 95 amino acids, about 2 amino acids to about 90 amino acids, about 2 amino acids to about 85 amino acids, about 2 amino acids to about 80 amino acids, about 2 amino acids to about 75 amino acids, about 2 amino acids to about 70 amino acids, about 2 amino acids to about 65 amino acids, about 2 amino acids to about 60 amino acids, about 2 amino acids to about 55 amino acids, about 2 amino acids to about 50 amino acids, about 2 amino acids to about 45 amino acids, about 2 amino acids to about 40 amino acids, about 2 amino acids to about 35 amino acids, about 2 amino acids to about 30 amino acids, about 2 amino acids to about 25 amino acids, about 2 amino acids to about 20 amino acids, about 2 amino acids to about 15 amino acids, about 2 amino acids to about 10 amino acids, about 2 amino acids to about 9 amino acids, about 2 amino acids to about 8 amino acids, about 2 amino acids to about 7 amino acids, about 2 amino acids to about 6 amino acids, about 2 amino acids to about 5 amino acids, about 2 amino acids to about 4 amino acids, about 3 amino acids to about 200 amino acids, about 3 amino acids to about 195 amino acids, about 3 amino acids to about 190 amino acids, about 3 amino acids to about 185 amino acids, about 3 amino acids to about 180 amino acids, about 3 amino acids to about 175 amino acids, about 3 amino acids to about 170 amino acids, about 3 amino acids to about 165 amino acids, about 3 amino acids to about 160 amino acids, about 3 amino acids to about 155 amino acids, about 3 amino acids to about 150 amino acids, about 3 amino acids to about 145 amino acids, about 3 amino acids to about 140 amino acids, about 3 amino acids to about 135 amino acids, about 3 amino acids to about 130 amino acids, about 3 amino acids to about 125 amino acids, about 3 amino acids to about 120 amino acids, about 3 amino acids to about 115 amino acids, about 3 amino acids to about 110 amino acids, about 3 amino acids to about 105 amino acids, about 3 amino acids to about 100 amino acids, about 3 amino acids to about 95 amino acids, about 3 amino acids to about 90 amino acids, about 3 amino acids to about 85 amino acids, about 3 amino acids to about 80 amino acids, about 3 amino acids to about 75 amino acids, about 3 amino acids to about 70 amino acids, about 3 amino acids to about 65 amino acids, about 3 amino acids to about 60 amino acids, about 3 amino acids to about 55 amino acids, about 3 amino acids to about 50 amino acids, about 3 amino acids to about 45 amino acids, about 3 amino acids to about 40 amino acids, about 3 amino acids to about 35 amino acids, about 3 amino acids to about 30 amino acids, about 3 amino acids to about 25 amino acids, about 3 amino acids to about 20 amino acids, about 3 amino acids to about 15 amino acids, about 3 amino acids to about 10 amino acids, about 3 amino acids to about 9 amino acids, about 3 amino acids to about 8 amino acids, about 3 amino acids to about 7 amino acids, about 3 amino acids to about 6 amino acids, about 3 amino acids to about 5 amino acids, about 4 amino acids to about 200 amino acids, about 4 amino acids to about 195 amino acids, about 4 amino acids to about 190 amino acids, about 4 amino acids to about 185 amino acids, about 4 amino acids to about 180 amino acids, about 4 amino acids to about 175 amino acids, about 4 amino acids to about 170 amino acids, about 4 amino acids to about 165 amino acids, about 4 amino acids to about 160 amino acids, about 4 amino acids to about 155 amino acids, about 4 amino acids to about 150 amino acids, about 4 amino acids to about 145 amino acids, about 4 amino acids to about 140 amino acids, about 4 amino acids to about 135 amino acids, about 4 amino acids to about 130 amino acids, about 4 amino acids to about 125 amino acids, about 4 amino acids to about 120 amino acids, about 4 amino acids to about 115 amino acids, about 4 amino acids to about 110 amino acids, about 4 amino acids to about 105 amino acids, about 4 amino acids to about 100 amino acids, about 4 amino acids to about 95 amino acids, about 4 amino acids to about 90 amino acids, about 4 amino acids to about 85 amino acids, about 4 amino acids to about 80 amino acids, about 4 amino acids to about 75 amino acids, about 4 amino acids to about 70 amino acids, about 4 amino acids to about 65 amino acids, about 4 amino acids to about 60 amino acids, about 4 amino acids to about 55 amino acids, about 4 amino acids to about 50 amino acids, about 4 amino acids to about 45 amino acids, about 4 amino acids to about 40 amino acids, about 4 amino acids to about 35 amino acids, about 4 amino acids to about 30 amino acids, about 4 amino acids to about 25 amino acids, about 4 amino acids to about 20 amino acids, about 4 amino acids to about 15 amino acids, about 4 amino acids to about 10 amino acids, about 4 amino acids to about 9 amino acids, about 4 amino acids to about 8 amino acids, about 4 amino acids to about 7 amino acids, about 4 amino acids to about 6 amino acids, about 5 amino acids to about 200 amino acids, about 5 amino acids to about 195 amino acids, about 5 amino acids to about 190 amino acids, about 5 amino acids to about 185 amino acids, about 5 amino acids to about 180 amino acids, about 5 amino acids to about 175 amino acids, about 5 amino acids to about 170 amino acids, about 5 amino acids to about 165 amino acids, about 5 amino acids to about 160 amino acids, about 5 amino acids to about 155 amino acids, about 5 amino acids to about 150 amino acids, about 5 amino acids to about 145 amino acids, about 5 amino acids to about 140 amino acids, about 5 amino acids to about 135 amino acids, about 5 amino acids to about 130 amino acids, about 5 amino acids to about 125 amino acids, about 5 amino acids to about 120 amino acids, about 5 amino acids to about 115 amino acids, about 5 amino acids to about 110 amino acids, about 5 amino acids to about 105 amino acids, about 5 amino acids to about 100 amino acids, about 5 amino acids to about 95 amino acids, about 5 amino acids to about 90 amino acids, about 5 amino acids to about 85 amino acids, about 5 amino acids to about 80 amino acids, about 5 amino acids to about 75 amino acids, about 5 amino acids to about 70 amino acids, about 5 amino acids to about 65 amino acids, about 5 amino acids to about 60 amino acids, about 5 amino acids to about 55 amino acids, about 5 amino acids to about 50 amino acids, about 5 amino acids to about 45 amino acids, about 5 amino acids to about 40 amino acids, about 5 amino acids to about 35 amino acids, about 5 amino acids to about 30 amino acids, about 5 amino acids to about 25 amino acids, about 5 amino acids to about 20 amino acids, about 5 amino acids to about 15 amino acids, about 5 amino acids to about 10 amino acids, about 5 amino acids to about 9 amino acids, about 5 amino acids to about 8 amino acids, about 5 amino acids to about 7 amino acids, about 6 amino acids to about 200 amino acids, about 6 amino acids to about 195 amino acids, about 6 amino acids to about 190 amino acids, about 6 amino acids to about 185 amino acids, about 6 amino acids to about 180 amino acids, about 6 amino acids to about 175 amino acids, about 6 amino acids to about 170 amino acids, about 6 amino acids to about 165 amino acids, about 6 amino acids to about 160 amino acids, about 6 amino acids to about 155 amino acids, about 6 amino acids to about 150 amino acids, about 6 amino acids to about 145 amino acids, about 6 amino acids to about 140 amino acids, about 6 amino acids to about 135 amino acids, about 6 amino acids to about 130 amino acids, about 6 amino acids to about 125 amino acids, about 6 amino acids to about 120 amino acids, about 6 amino acids to about 115 amino acids, about 6 amino acids to about 110 amino acids, about 6 amino acids to about 105 amino acids, about 6 amino acids to about 100 amino acids, about 6 amino acids to about 95 amino acids, about 6 amino acids to about 90 amino acids, about 6 amino acids to about 85 amino acids, about 6 amino acids to about 80 amino acids, about 6 amino acids to about 75 amino acids, about 6 amino acids to about 70 amino acids, about 6 amino acids to about 65 amino acids, about 6 amino acids to about 60 amino acids, about 6 amino acids to about 55 amino acids, about 6 amino acids to about 50 amino acids, about 6 amino acids to about 45 amino acids, about 6 amino acids to about 40 amino acids, about 6 amino acids to about 35 amino acids, about 6 amino acids to about 30 amino acids, about 6 amino acids to about 25 amino acids, about 6 amino acids to about 20 amino acids, about 6 amino acids to about 15 amino acids, about 6 amino acids to about 10 amino acids, about 6 amino acids to about 9 amino acids, about 6 amino acids to about 8 amino acids, about 7 amino acids to about 200 amino acids, about 7 amino acids to about 195 amino acids, about 7 amino acids to about 190 amino acids, about 7 amino acids to about 185 amino acids, about 7 amino acids to about 180 amino acids, about 7 amino acids to about 175 amino acids, about 7 amino acids to about 170 amino acids, about 7 amino acids to about 165 amino acids, about 7 amino acids to about 160 amino acids, about 7 amino acids to about 155 amino acids, about 7 amino acids to about 150 amino acids, about 7 amino acids to about 145 amino acids, about 7 amino acids to about 140 amino acids, about 7 amino acids to about 135 amino acids, about 7 amino acids to about 130 amino acids, about 7 amino acids to about 125 amino acids, about 7 amino acids to about 120 amino acids, about 7 amino acids to about 115 amino acids, about 7 amino acids to about 110 amino acids, about 7 amino acids to about 105 amino acids, about 7 amino acids to about 100 amino acids, about 7 amino acids to about 95 amino acids, about 7 amino acids to about 90 amino acids, about 7 amino acids to about 85 amino acids, about 7 amino acids to about 80 amino acids, about 7 amino acids to about 75 amino acids, about 7 amino acids to about 70 amino acids, about 7 amino acids to about 65 amino acids, about 7 amino acids to about 60 amino acids, about 7 amino acids to about 55 amino acids, about 7 amino acids to about 50 amino acids, about 7 amino acids to about 45 amino acids, about 7 amino acids to about 40 amino acids, about 7 amino acids to about 35 amino acids, about 7 amino acids to about 30 amino acids, about 7 amino acids to about 25 amino acids, about 7 amino acids to about 20 amino acids, about 7 amino acids to about 15 amino acids, about 7 amino acids to about 10 amino acids, about 7 amino acids to about 9 amino acids, about 8 amino acids to about 200 amino acids, about 8 amino acids to about 195 amino acids, about 8 amino acids to about 190 amino acids, about 8 amino acids to about 185 amino acids, about 8 amino acids to about 180 amino acids, about 8 amino acids to about 175 amino acids, about 8 amino acids to about 170 amino acids, about 8 amino acids to about 165 amino acids, about 8 amino acids to about 160 amino acids, about 8 amino acids to about 155 amino acids, about 8 amino acids to about 150 amino acids, about 8 amino acids to about 145 amino acids, about 8 amino acids to about 140 amino acids, about 8 amino acids to about 135 amino acids, about 8 amino acids to about 130 amino acids, about 8 amino acids to about 125 amino acids, about 8 amino acids to about 120 amino acids, about 8 amino acids to about 115 amino acids, about 8 amino acids to about 110 amino acids, about 8 amino acids to about 105 amino acids, about 8 amino acids to about 100 amino acids, about 8 amino acids to about 95 amino acids, about 8 amino acids to about 90 amino acids, about 8 amino acids to about 85 amino acids, about 8 amino acids to about 80 amino acids, about 8 amino acids to about 75 amino acids, about 8 amino acids to about 70 amino acids, about 8 amino acids to about 65 amino acids, about 8 amino acids to about 60 amino acids, about 8 amino acids to about 55 amino acids, about 8 amino acids to about 50 amino acids, about 8 amino acids to about 45 amino acids, about 8 amino acids to about 40 amino acids, about 8 amino acids to about 35 amino acids, about 8 amino acids to about 30 amino acids, about 8 amino acids to about 25 amino acids, about 8 amino acids to about 20 amino acids, about 8 amino acids to about 15 amino acids, about 8 amino acids to about 10 amino acids, about 10 amino acids to about 200 amino acids, about 10 amino acids to about 195 amino acids, about 10 amino acids to about 190 amino acids, about 10 amino acids to about 185 amino acids, about 10 amino acids to about 180 amino acids, about 10 amino acids to about 175 amino acids, about 10 amino acids to about 170 amino acids, about 10 amino acids to about 165 amino acids, about 10 amino acids to about 160 amino acids, about 10 amino acids to about 155 amino acids, about 10 amino acids to about 150 amino acids, about 10 amino acids to about 145 amino acids, about 10 amino acids to about 140 amino acids, about 10 amino acids to about 135 amino acids, about 10 amino acids to about 130 amino acids, about 10 amino acids to about 125 amino acids, about 10 amino acids to about 120 amino acids, about 10 amino acids to about 115 amino acids, about 10 amino acids to about 110 amino acids, about 10 amino acids to about 105 amino acids, about 10 amino acids to about 100 amino acids, about 10 amino acids to about 95 amino acids, about 10 amino acids to about 90 amino acids, about 10 amino acids to about 85 amino acids, about 10 amino acids to about 80 amino acids, about 10 amino acids to about 75 amino acids, about 10 amino acids to about 70 amino acids, about 10 amino acids to about 65 amino acids, about 10 amino acids to about 60 amino acids, about 10 amino acids to about 55 amino acids, about 10 amino acids to about 50 amino acids, about 10 amino acids to about 45 amino acids, about 10 amino acids to about 40 amino acids, about 10 amino acids to about 35 amino acids, about 10 amino acids to about 30 amino acids, about 10 amino acids to about 25 amino acids, about 10 amino acids to about 20 amino acids, about 10 amino acids to about 15 amino acids, about 15 amino acids to about 200 amino acids, about 15 amino acids to about 195 amino acids, about 15 amino acids to about 190 amino acids, about 15 amino acids to about 185 amino acids, about 15 amino acids to about 180 amino acids, about 15 amino acids to about 175 amino acids, about 15 amino acids to about 170 amino acids, about 15 amino acids to about 165 amino acids, about 15 amino acids to about 160 amino acids, about 15 amino acids to about 155 amino acids, about 15 amino acids to about 150 amino acids, about 15 amino acids to about 145 amino acids, about 15 amino acids to about 140 amino acids, about 15 amino acids to about 135 amino acids, about 15 amino acids to about 130 amino acids, about 15 amino acids to about 125 amino acids, about 15 amino acids to about 120 amino acids, about 15 amino acids to about 115 amino acids, about 15 amino acids to about 110 amino acids, about 15 amino acids to about 105 amino acids, about 15 amino acids to about 100 amino acids, about 15 amino acids to about 95 amino acids, about 15 amino acids to about 90 amino acids, about 15 amino acids to about 85 amino acids, about 15 amino acids to about 80 amino acids, about 15 amino acids to about 75 amino acids, about 15 amino acids to about 70 amino acids, about 15 amino acids to about 65 amino acids, about 15 amino acids to about 60 amino acids, about 15 amino acids to about 55 amino acids, about 15 amino acids to about 50 amino acids, about 15 amino acids to about 45 amino acids, about 15 amino acids to about 40 amino acids, about 15 amino acids to about 35 amino acids, about 15 amino acids to about 30 amino acids, about 15 amino acids to about 25 amino acids, about 15 amino acids to about 20 amino acids, about 20 amino acids to about 200 amino acids, about 20 amino acids to about 195 amino acids, about 20 amino acids to about 190 amino acids, about 20 amino acids to about 185 amino acids, about 20 amino acids to about 180 amino acids, about 20 amino acids to about 175 amino acids, about 20 amino acids to about 170 amino acids, about 20 amino acids to about 165 amino acids, about 20 amino acids to about 160 amino acids, about 20 amino acids to about 155 amino acids, about 20 amino acids to about 150 amino acids, about 20 amino acids to about 145 amino acids, about 20 amino acids to about 140 amino acids, about 20 amino acids to about 135 amino acids, about 20 amino acids to about 130 amino acids, about 20 amino acids to about 125 amino acids, about 20 amino acids to about 120 amino acids, about 20 amino acids to about 115 amino acids, about 20 amino acids to about 110 amino acids, about 20 amino acids to about 105 amino acids, about 20 amino acids to about 100 amino acids, about 20 amino acids to about 95 amino acids, about 20 amino acids to about 90 amino acids, about 20 amino acids to about 85 amino acids, about 20 amino acids to about 80 amino acids, about 20 amino acids to about 75 amino acids, about 20 amino acids to about 70 amino acids, about 20 amino acids to about 65 amino acids, about 20 amino acids to about 60 amino acids, about 20 amino acids to about 55 amino acids, about 20 amino acids to about 50 amino acids, about 20 amino acids to about 45 amino acids, about 20 amino acids to about 40 amino acids, about 20 amino acids to about 35 amino acids, about 20 amino acids to about 30 amino acids, about 20 amino acids to about 25 amino acids, about 25 amino acids to about 200 amino acids, about 25 amino acids to about 195 amino acids, about 25 amino acids to about 190 amino acids, about 25 amino acids to about 185 amino acids, about 25 amino acids to about 180 amino acids, about 25 amino acids to about 175 amino acids, about 25 amino acids to about 170 amino acids, about 25 amino acids to about 165 amino acids, about 25 amino acids to about 160 amino acids, about 25 amino acids to about 155 amino acids, about 25 amino acids to about 150 amino acids, about 25 amino acids to about 145 amino acids, about 25 amino acids to about 140 amino acids, about 25 amino acids to about 135 amino acids, about 25 amino acids to about 130 amino acids, about 25 amino acids to about 125 amino acids, about 25 amino acids to about 120 amino acids, about 25 amino acids to about 115 amino acids, about 25 amino acids to about 110 amino acids, about 25 amino acids to about 105 amino acids, about 25 amino acids to about 100 amino acids, about 25 amino acids to about 95 amino acids, about 25 amino acids to about 90 amino acids, about 25 amino acids to about 85 amino acids, about 25 amino acids to about 80 amino acids, about 25 amino acids to about 75 amino acids, about 25 amino acids to about 70 amino acids, about 25 amino acids to about 65 amino acids, about 25 amino acids to about 60 amino acids, about 25 amino acids to about 55 amino acids, about 25 amino acids to about 50 amino acids, about 25 amino acids to about 45 amino acids, about 25 amino acids to about 40 amino acids, about 25 amino acids to about 35 amino acids, about 25 amino acids to about 30 amino acids, about 30 amino acids to about 200 amino acids, about 30 amino acids to about 195 amino acids, about 30 amino acids to about 190 amino acids, about 30 amino acids to about 185 amino acids, about 30 amino acids to about 180 amino acids, about 30 amino acids to about 175 amino acids, about 30 amino acids to about 170 amino acids, about 30 amino acids to about 165 amino acids, about 30 amino acids to about 160 amino acids, about 30 amino acids to about 155 amino acids, about 30 amino acids to about 150 amino acids, about 30 amino acids to about 145 amino acids, about 30 amino acids to about 140 amino acids, about 30 amino acids to about 135 amino acids, about 30 amino acids to about 130 amino acids, about 30 amino acids to about 125 amino acids, about 30 amino acids to about 120 amino acids, about 30 amino acids to about 115 amino acids, about 30 amino acids to about 110 amino acids, about 30 amino acids to about 105 amino acids, about 30 amino acids to about 100 amino acids, about 30 amino acids to about 95 amino acids, about 30 amino acids to about 90 amino acids, about 30 amino acids to about 85 amino acids, about 30 amino acids to about 80 amino acids, about 30 amino acids to about 75 amino acids, about 30 amino acids to about 70 amino acids, about 30 amino acids to about 65 amino acids, about 30 amino acids to about 60 amino acids, about 30 amino acids to about 55 amino acids, about 30 amino acids to about 50 amino acids, about 30 amino acids to about 45 amino acids, about 30 amino acids to about 40 amino acids, about 30 amino acids to about 35 amino acids, about 35 amino acids to about 200 amino acids, about 35 amino acids to about 195 amino acids, about 35 amino acids to about 190 amino acids, about 35 amino acids to about 185 amino acids, about 35 amino acids to about 180 amino acids, about 35 amino acids to about 175 amino acids, about 35 amino acids to about 170 amino acids, about 35 amino acids to about 165 amino acids, about 35 amino acids to about 160 amino acids, about 35 amino acids to about 155 amino acids, about 35 amino acids to about 150 amino acids, about 35 amino acids to about 145 amino acids, about 35 amino acids to about 140 amino acids, about 35 amino acids to about 135 amino acids, about 35 amino acids to about 130 amino acids, about 35 amino acids to about 125 amino acids, about 35 amino acids to about 120 amino acids, about 35 amino acids to about 115 amino acids, about 35 amino acids to about 110 amino acids, about 35 amino acids to about 105 amino acids, about 35 amino acids to about 100 amino acids, about 35 amino acids to about 95 amino acids, about 35 amino acids to about 90 amino acids, about 35 amino acids to about 85 amino acids, about 35 amino acids to about 80 amino acids, about 35 amino acids to about 75 amino acids, about 35 amino acids to about 70 amino acids, about 35 amino acids to about 65 amino acids, about 35 amino acids to about 60 amino acids, about 35 amino acids to about 55 amino acids, about 35 amino acids to about 50 amino acids, about 35 amino acids to about 45 amino acids, about 35 amino acids to about 40 amino acids, about 40 amino acids to about 200 amino acids, about 40 amino acids to about 195 amino acids, about 40 amino acids to about 190 amino acids, about 40 amino acids to about 185 amino acids, about 40 amino acids to about 180 amino acids, about 40 amino acids to about 175 amino acids, about 40 amino acids to about 170 amino acids, about 40 amino acids to about 165 amino acids, about 40 amino acids to about 160 amino acids, about 40 amino acids to about 155 amino acids, about 40 amino acids to about 150 amino acids, about 40 amino acids to about 145 amino acids, about 40 amino acids to about 140 amino acids, about 40 amino acids to about 135 amino acids, about 40 amino acids to about 130 amino acids, about 40 amino acids to about 125 amino acids, about 40 amino acids to about 120 amino acids, about 40 amino acids to about 115 amino acids, about 40 amino acids to about 110 amino acids, about 40 amino acids to about 105 amino acids, about 40 amino acids to about 100 amino acids, about 40 amino acids to about 95 amino acids, about 40 amino acids to about 90 amino acids, about 40 amino acids to about 85 amino acids, about 40 amino acids to about 80 amino acids, about 40 amino acids to about 75 amino acids, about 40 amino acids to about 70 amino acids, about 40 amino acids to about 65 amino acids, about 40 amino acids to about 60 amino acids, about 40 amino acids to about 55 amino acids, about 40 amino acids to about 50 amino acids, about 40 amino acids to about 45 amino acids, about 45 amino acids to about 200 amino acids, about 45 amino acids to about 195 amino acids, about 45 amino acids to about 190 amino acids, about 45 amino acids to about 185 amino acids, about 45 amino acids to about 180 amino acids, about 45 amino acids to about 175 amino acids, about 45 amino acids to about 170 amino acids, about 45 amino acids to about 165 amino acids, about 45 amino acids to about 160 amino acids, about 45 amino acids to about 155 amino acids, about 45 amino acids to about 150 amino acids, about 45 amino acids to about 145 amino acids, about 45 amino acids to about 140 amino acids, about 45 amino acids to about 135 amino acids, about 45 amino acids to about 130 amino acids, about 45 amino acids to about 125 amino acids, about 45 amino acids to about 120 amino acids, about 45 amino acids to about 115 amino acids, about 45 amino acids to about 110 amino acids, about 45 amino acids to about 105 amino acids, about 45 amino acids to about 100 amino acids, about 45 amino acids to about 95 amino acids, about 45 amino acids to about 90 amino acids, about 45 amino acids to about 85 amino acids, about 45 amino acids to about 80 amino acids, about 45 amino acids to about 75 amino acids, about 45 amino acids to about 70 amino acids, about 45 amino acids to about 65 amino acids, about 45 amino acids to about 60 amino acids, about 45 amino acids to about 55 amino acids, about 45 amino acids to about 50 amino acids, about 50 amino acids to about 200 amino acids, about 50 amino acids to about 195 amino acids, about 50 amino acids to about 190 amino acids, about 50 amino acids to about 185 amino acids, about 50 amino acids to about 180 amino acids, about 50 amino acids to about 175 amino acids, about 50 amino acids to about 170 amino acids, about 50 amino acids to about 165 amino acids, about 50 amino acids to about 160 amino acids, about 50 amino acids to about 155 amino acids, about 50 amino acids to about 150 amino acids, about 50 amino acids to about 145 amino acids, about 50 amino acids to about 140 amino acids, about 50 amino acids to about 135 amino acids, about 50 amino acids to about 130 amino acids, about 50 amino acids to about 125 amino acids, about 50 amino acids to about 120 amino acids, about 50 amino acids to about 115 amino acids, about 50 amino acids to about 110 amino acids, about 50 amino acids to about 105 amino acids, about 50 amino acids to about 100 amino acids, about 50 amino acids to about 95 amino acids, about 50 amino acids to about 90 amino acids, about 50 amino acids to about 85 amino acids, about 50 amino acids to about 80 amino acids, about 50 amino acids to about 75 amino acids, about 50 amino acids to about 70 amino acids, about 50 amino acids to about 65 amino acids, about 50 amino acids to about 60 amino acids, about 50 amino acids to about 55 amino acids, about 55 amino acids to about 200 amino acids, about 55 amino acids to about 195 amino acids, about 55 amino acids to about 190 amino acids, about 55 amino acids to about 185 amino acids, about 55 amino acids to about 180 amino acids, about 55 amino acids to about 175 amino acids, about 55 amino acids to about 170 amino acids, about 55 amino acids to about 165 amino acids, about 55 amino acids to about 160 amino acids, about 55 amino acids to about 155 amino acids, about 55 amino acids to about 150 amino acids, about 55 amino acids to about 145 amino acids, about 55 amino acids to about 140 amino acids, about 55 amino acids to about 135 amino acids, about 55 amino acids to about 130 amino acids, about 55 amino acids to about 125 amino acids, about 55 amino acids to about 120 amino acids, about 55 amino acids to about 115 amino acids, about 55 amino acids to about 110 amino acids, about 55 amino acids to about 105 amino acids, about 55 amino acids to about 100 amino acids, about 55 amino acids to about 95 amino acids, about 55 amino acids to about 90 amino acids, about 55 amino acids to about 85 amino acids, about 55 amino acids to about 80 amino acids, about 55 amino acids to about 75 amino acids, about 55 amino acids to about 70 amino acids, about 55 amino acids to about 65 amino acids, about 55 amino acids to about 60 amino acids, about 60 amino acids to about 200 amino acids, about 60 amino acids to about 195 amino acids, about 60 amino acids to about 190 amino acids, about 60 amino acids to about 185 amino acids, about 60 amino acids to about 180 amino acids, about 60 amino acids to about 175 amino acids, about 60 amino acids to about 170 amino acids, about 60 amino acids to about 165 amino acids, about 60 amino acids to about 160 amino acids, about 60 amino acids to about 155 amino acids, about 60 amino acids to about 150 amino acids, about 60 amino acids to about 145 amino acids, about 60 amino acids to about 140 amino acids, about 60 amino acids to about 135 amino acids, about 60 amino acids to about 130 amino acids, about 60 amino acids to about 125 amino acids, about 60 amino acids to about 120 amino acids, about 60 amino acids to about 115 amino acids, about 60 amino acids to about 110 amino acids, about 60 amino acids to about 105 amino acids, about 60 amino acids to about 100 amino acids, about 60 amino acids to about 95 amino acids, about 60 amino acids to about 90 amino acids, about 60 amino acids to about 85 amino acids, about 60 amino acids to about 80 amino acids, about 60 amino acids to about 75 amino acids, about 60 amino acids to about 70 amino acids, about 60 amino acids to about 65 amino acids, about 65 amino acids to about 200 amino acids, about 65 amino acids to about 195 amino acids, about 65 amino acids to about 190 amino acids, about 65 amino acids to about 185 amino acids, about 65 amino acids to about 180 amino acids, about 65 amino acids to about 175 amino acids, about 65 amino acids to about 170 amino acids, about 65 amino acids to about 165 amino acids, about 65 amino acids to about 160 amino acids, about 65 amino acids to about 155 amino acids, about 65 amino acids to about 150 amino acids, about 65 amino acids to about 145 amino acids, about 65 amino acids to about 140 amino acids, about 65 amino acids to about 135 amino acids, about 65 amino acids to about 130 amino acids, about 65 amino acids to about 125 amino acids, about 65 amino acids to about 120 amino acids, about 65 amino acids to about 115 amino acids, about 65 amino acids to about 110 amino acids, about 65 amino acids to about 105 amino acids, about 65 amino acids to about 100 amino acids, about 65 amino acids to about 95 amino acids, about 65 amino acids to about 90 amino acids, about 65 amino acids to about 85 amino acids, about 65 amino acids to about 80 amino acids, about 65 amino acids to about 75 amino acids, about 65 amino acids to about 70 amino acids, about 70 amino acids to about 200 amino acids, about 70 amino acids to about 195 amino acids, about 70 amino acids to about 190 amino acids, about 70 amino acids to about 185 amino acids, about 70 amino acids to about 180 amino acids, about 70 amino acids to about 175 amino acids, about 70 amino acids to about 170 amino acids, about 70 amino acids to about 165 amino acids, about 70 amino acids to about 160 amino acids, about 70 amino acids to about 155 amino acids, about 70 amino acids to about 150 amino acids, about 70 amino acids to about 145 amino acids, about 70 amino acids to about 140 amino acids, about 70 amino acids to about 135 amino acids, about 70 amino acids to about 130 amino acids, about 70 amino acids to about 125 amino acids, about 70 amino acids to about 120 amino acids, about 70 amino acids to about 115 amino acids, about 70 amino acids to about 110 amino acids, about 70 amino acids to about 105 amino acids, about 70 amino acids to about 100 amino acids, about 70 amino acids to about 95 amino acids, about 70 amino acids to about 90 amino acids, about 70 amino acids to about 85 amino acids, about 70 amino acids to about 80 amino acids, about 70 amino acids to about 75 amino acids, about 75 amino acids to about 200 amino acids, about 75 amino acids to about 195 amino acids, about 75 amino acids to about 190 amino acids, about 75 amino acids to about 185 amino acids, about 75 amino acids to about 180 amino acids, about 75 amino acids to about 175 amino acids, about 75 amino acids to about 170 amino acids, about 75 amino acids to about 165 amino acids, about 75 amino acids to about 160 amino acids, about 75 amino acids to about 155 amino acids, about 75 amino acids to about 150 amino acids, about 75 amino acids to about 145 amino acids, about 75 amino acids to about 140 amino acids, about 75 amino acids to about 135 amino acids, about 75 amino acids to about 130 amino acids, about 75 amino acids to about 125 amino acids, about 75 amino acids to about 120 amino acids, about 75 amino acids to about 115 amino acids, about 75 amino acids to about 110 amino acids, about 75 amino acids to about 105 amino acids, about 75 amino acids to about 100 amino acids, about 75 amino acids to about 95 amino acids, about 75 amino acids to about 90 amino acids, about 75 amino acids to about 85 amino acids, about 75 amino acids to about 80 amino acids, about 80 amino acids to about 200 amino acids, about 80 amino acids to about 195 amino acids, about 80 amino acids to about 190 amino acids, about 80 amino acids to about 185 amino acids, about 80 amino acids to about 180 amino acids, about 80 amino acids to about 175 amino acids, about 80 amino acids to about 170 amino acids, about 80 amino acids to about 165 amino acids, about 80 amino acids to about 160 amino acids, about 80 amino acids to about 155 amino acids, about 80 amino acids to about 150 amino acids, about 80 amino acids to about 145 amino acids, about 80 amino acids to about 140 amino acids, about 80 amino acids to about 135 amino acids, about 80 amino acids to about 130 amino acids, about 80 amino acids to about 125 amino acids, about 80 amino acids to about 120 amino acids, about 80 amino acids to about 115 amino acids, about 80 amino acids to about 110 amino acids, about 80 amino acids to about 105 amino acids, about 80 amino acids to about 100 amino acids, about 80 amino acids to about 95 amino acids, about 80 amino acids to about 90 amino acids, about 80 amino acids to about 85 amino acids, about 85 amino acids to about 200 amino acids, about 85 amino acids to about 195 amino acids, about 85 amino acids to about 190 amino acids, about 85 amino acids to about 185 amino acids, about 85 amino acids to about 180 amino acids, about 85 amino acids to about 175 amino acids, about 85 amino acids to about 170 amino acids, about 85 amino acids to about 165 amino acids, about 85 amino acids to about 160 amino acids, about 85 amino acids to about 155 amino acids, about 85 amino acids to about 150 amino acids, about 85 amino acids to about 145 amino acids, about 85 amino acids to about 140 amino acids, about 85 amino acids to about 135 amino acids, about 85 amino acids to about 130 amino acids, about 85 amino acids to about 125 amino acids, about 85 amino acids to about 120 amino acids, about 85 amino acids to about 115 amino acids, about 85 amino acids to about 110 amino acids, about 85 amino acids to about 105 amino acids, about 85 amino acids to about 100 amino acids, about 85 amino acids to about 95 amino acids, about 85 amino acids to about 90 amino acids, about 90 amino acids to about 200 amino acids, about 90 amino acids to about 195 amino acids, about 90 amino acids to about 190 amino acids, about 90 amino acids to about 185 amino acids, about 90 amino acids to about 180 amino acids, about 90 amino acids to about 175 amino acids, about 90 amino acids to about 170 amino acids, about 90 amino acids to about 165 amino acids, about 90 amino acids to about 160 amino acids, about 90 amino acids to about 155 amino acids, about 90 amino acids to about 150 amino acids, about 90 amino acids to about 145 amino acids, about 90 amino acids to about 140 amino acids, about 90 amino acids to about 135 amino acids, about 90 amino acids to about 130 amino acids, about 90 amino acids to about 125 amino acids, about 90 amino acids to about 120 amino acids, about 90 amino acids to about 115 amino acids, about 90 amino acids to about 110 amino acids, about 90 amino acids to about 105 amino acids, about 90 amino acids to about 100 amino acids, about 90 amino acids to about 95 amino acids, about 95 amino acids to about 200 amino acids, about 95 amino acids to about 195 amino acids, about 95 amino acids to about 190 amino acids, about 95 amino acids to about 185 amino acids, about 95 amino acids to about 180 amino acids, about 95 amino acids to about 175 amino acids, about 95 amino acids to about 170 amino acids, about 95 amino acids to about 165 amino acids, about 95 amino acids to about 160 amino acids, about 95 amino acids to about 155 amino acids, about 95 amino acids to about 150 amino acids, about 95 amino acids to about 145 amino acids, about 95 amino acids to about 140 amino acids, about 95 amino acids to about 135 amino acids, about 95 amino acids to about 130 amino acids, about 95 amino acids to about 125 amino acids, about 95 amino acids to about 120 amino acids, about 95 amino acids to about 115 amino acids, about 95 amino acids to about 110 amino acids, about 95 amino acids to about 105 amino acids, about 95 amino acids to about 100 amino acids, about 100 amino acids to about 200 amino acids, about 100 amino acids to about 195 amino acids, about 100 amino acids to about 190 amino acids, about 100 amino acids to about 185 amino acids, about 100 amino acids to about 180 amino acids, about 100 amino acids to about 175 amino acids, about 100 amino acids to about 170 amino acids, about 100 amino acids to about 165 amino acids, about 100 amino acids to about 160 amino acids, about 100 amino acids to about 155 amino acids, about 100 amino acids to about 150 amino acids, about 100 amino acids to about 145 amino acids, about 100 amino acids to about 140 amino acids, about 100 amino acids to about 135 amino acids, about 100 amino acids to about 130 amino acids, about 100 amino acids to about 125 amino acids, about 100 amino acids to about 120 amino acids, about 100 amino acids to about 115 amino acids, about 100 amino acids to about 110 amino acids, about 100 amino acids to about 105 amino acids, about 105 amino acids to about 200 amino acids, about 105 amino acids to about 195 amino acids, about 105 amino acids to about 190 amino acids, about 105 amino acids to about 185 amino acids, about 105 amino acids to about 180 amino acids, about 105 amino acids to about 175 amino acids, about 105 amino acids to about 170 amino acids, about 105 amino acids to about 165 amino acids, about 105 amino acids to about 160 amino acids, about 105 amino acids to about 155 amino acids, about 105 amino acids to about 150 amino acids, about 105 amino acids to about 145 amino acids, about 105 amino acids to about 140 amino acids, about 105 amino acids to about 135 amino acids, about 105 amino acids to about 130 amino acids, about 105 amino acids to about 125 amino acids, about 105 amino acids to about 120 amino acids, about 105 amino acids to about 115 amino acids, about 105 amino acids to about 110 amino acids, about 110 amino acids to about 200 amino acids, about 110 amino acids to about 195 amino acids, about 110 amino acids to about 190 amino acids, about 110 amino acids to about 185 amino acids, about 110 amino acids to about 180 amino acids, about 110 amino acids to about 175 amino acids, about 110 amino acids to about 170 amino acids, about 110 amino acids to about 165 amino acids, about 110 amino acids to about 160 amino acids, about 110 amino acids to about 155 amino acids, about 110 amino acids to about 150 amino acids, about 110 amino acids to about 145 amino acids, about 110 amino acids to about 140 amino acids, about 110 amino acids to about 135 amino acids, about 110 amino acids to about 130 amino acids, about 110 amino acids to about 125 amino acids, about 110 amino acids to about 120 amino acids, about 110 amino acids to about 115 amino acids, about 115 amino acids to about 200 amino acids, about 115 amino acids to about 195 amino acids, about 115 amino acids to about 190 amino acids, about 115 amino acids to about 185 amino acids, about 115 amino acids to about 180 amino acids, about 115 amino acids to about 175 amino acids, about 115 amino acids to about 170 amino acids, about 115 amino acids to about 165 amino acids, about 115 amino acids to about 160 amino acids, about 115 amino acids to about 155 amino acids, about 115 amino acids to about 150 amino acids, about 115 amino acids to about 145 amino acids, about 115 amino acids to about 140 amino acids, about 115 amino acids to about 135 amino acids, about 115 amino acids to about 130 amino acids, about 115 amino acids to about 125 amino acids, about 115 amino acids to about 120 amino acids, about 120 amino acids to about 200 amino acids, about 120 amino acids to about 195 amino acids, about 120 amino acids to about 190 amino acids, about 120 amino acids to about 185 amino acids, about 120 amino acids to about 180 amino acids, about 120 amino acids to about 175 amino acids, about 120 amino acids to about 170 amino acids, about 120 amino acids to about 165 amino acids, about 120 amino acids to about 160 amino acids, about 120 amino acids to about 155 amino acids, about 120 amino acids to about 150 amino acids, about 120 amino acids to about 145 amino acids, about 120 amino acids to about 140 amino acids, about 120 amino acids to about 135 amino acids, about 120 amino acids to about 130 amino acids, about 120 amino acids to about 125 amino acids, about 125 amino acids to about 200 amino acids, about 125 amino acids to about 195 amino acids, about 125 amino acids to about 190 amino acids, about 125 amino acids to about 185 amino acids, about 125 amino acids to about 180 amino acids, about 125 amino acids to about 175 amino acids, about 125 amino acids to about 170 amino acids, about 125 amino acids to about 165 amino acids, about 125 amino acids to about 160 amino acids, about 125 amino acids to about 155 amino acids, about 125 amino acids to about 150 amino acids, about 125 amino acids to about 145 amino acids, about 125 amino acids to about 140 amino acids, about 125 amino acids to about 135 amino acids, about 125 amino acids to about 130 amino acids, about 130 amino acids to about 200 amino acids, about 130 amino acids to about 195 amino acids, about 130 amino acids to about 190 amino acids, about 130 amino acids to about 185 amino acids, about 130 amino acids to about 180 amino acids, about 130 amino acids to about 175 amino acids, about 130 amino acids to about 170 amino acids, about 130 amino acids to about 165 amino acids, about 130 amino acids to about 160 amino acids, about 130 amino acids to about 155 amino acids, about 130 amino acids to about 150 amino acids, about 130 amino acids to about 145 amino acids, about 130 amino acids to about 140 amino acids, about 130 amino acids to about 135 amino acids, about 135 amino acids to about 200 amino acids, about 135 amino acids to about 195 amino acids, about 135 amino acids to about 190 amino acids, about 135 amino acids to about 185 amino acids, about 135 amino acids to about 180 amino acids, about 135 amino acids to about 175 amino acids, about 135 amino acids to about 170 amino acids, about 135 amino acids to about 165 amino acids, about 135 amino acids to about 160 amino acids, about 135 amino acids to about 155 amino acids, about 135 amino acids to about 150 amino acids, about 135 amino acids to about 145 amino acids, about 135 amino acids to about 140 amino acids, about 140 amino acids to about 200 amino acids, about 140 amino acids to about 195 amino acids, about 140 amino acids to about 190 amino acids, about 140 amino acids to about 185 amino acids, about 140 amino acids to about 180 amino acids, about 140 amino acids to about 175 amino acids, about 140 amino acids to about 170 amino acids, about 140 amino acids to about 165 amino acids, about 140 amino acids to about 160 amino acids, about 140 amino acids to about 155 amino acids, about 140 amino acids to about 150 amino acids, about 40 amino acids to about 145 amino acids, about 145 amino acids to about 200 amino acids, about 145 amino acids to about 195 amino acids, about 145 amino acids to about 190 amino acids, about 145 amino acids to about 185 amino acids, about 145 amino acids to about 180 amino acids, about 145 amino acids to about 175 amino acids, about 145 amino acids to about 170 amino acids, about 145 amino acids to about 165 amino acids, about 145 amino acids to about 160 amino acids, about 145 amino acids to about 155 amino acids, about 145 amino acids to about 150 amino acids, about 150 amino acids to about 200 amino acids, about 150 amino acids to about 195 amino acids, about 150 amino acids to about 190 amino acids, about 150 amino acids to about 185 amino acids, about 150 amino acids to about 180 amino acids, about 150 amino acids to about 175 amino acids, about 150 amino acids to about 170 amino acids, about 150 amino acids to about 165 amino acids, about 150 amino acids to about 160 amino acids, about 150 amino acids to about 155 amino acids, about 155 amino acids to about 200 amino acids, about 155 amino acids to about 195 amino acids, about 155 amino acids to about 190 amino acids, about 155 amino acids to about 185 amino acids, about 155 amino acids to about 180 amino acids, about 155 amino acids to about 175 amino acids, about 155 amino acids to about 170 amino acids, about 155 amino acids to about 165 amino acids, about 155 amino acids to about 160 amino acids, about 160 amino acids to about 200 amino acids, about 160 amino acids to about 195 amino acids, about 160 amino acids to about 190 amino acids, about 160 amino acids to about 185 amino acids, about 160 amino acids to about 180 amino acids, about 160 amino acids to about 175 amino acids, about 160 amino acids to about 170 amino acids, about 160 amino acids to about 165 amino acids, about 165 amino acids to about 200 amino acids, about 165 amino acids to about 195 amino acids, about 165 amino acids to about 190 amino acids, about 165 amino acids to about 185 amino acids, about 165 amino acids to about 180 amino acids, about 165 amino acids to about 175 amino acids, about 165 amino acids to about 170 amino acids, about 170 amino acids to about 200 amino acids, about 170 amino acids to about 195 amino acids, about 170 amino acids to about 190 amino acids, about 170 amino acids to about 185 amino acids, about 170 amino acids to about 180 amino acids, about 170 amino acids to about 175 amino acids, about 175 amino acids to about 200 amino acids, about 175 amino acids to about 195 amino acids, about 175 amino acids to about 190 amino acids, about 175 amino acids to about 185 amino acids, about 175 amino acids to about 180 amino acids, about 180 amino acids to about 200 amino acids, about 180 amino acids to about 195 amino acids, about 180 amino acids to about 190 amino acids, about 180 amino acids to about 185 amino acids, about 185 amino acids to about 200 amino acids, about 185 amino acids to about 195 amino acids, about 185 amino acids to about 190 amino acids, about 190 amino acids to about 200 amino acids, about 190 amino acids to about 195 amino acids, about 195 amino acids to about 200 amino acids, deleted. In some embodiments where two or more amino acids are deleted from the sequence of a wildtype, full-length otoferlin protein, the two or more deleted amino acids can be contiguous in the sequence of the wildtype, full-length protein. In other examples where two or more amino acids are deleted from the sequence of a wildtype, full-length otoferlin protein, the two or more deleted amino acids are not contiguous in the sequence of the wildtype, full-length protein. One skilled in the art would appreciate that amino acids that are not conserved between wildtype, full-length otoferlin proteins from different species can be deleted without losing activity, while those amino acids that are conserved between wildtype, full-length otoferlin proteins from different species should not be deleted as they are more likely (than amino acids that are not conserved between different species) to be involved in activity.

In some examples, an active otoferlin protein can, e.g., include a sequence of a wildtype, full-length otoferlin protein that has between 1 amino acid to about 100 amino acids, 1 amino acid to about 95 amino acids, 1 amino acid to about 90 amino acids, 1 amino acid to about 85 amino acids, 1 amino acid to about 80 amino acids, 1 amino acid to about 75 amino acids, 1 amino acid to about 70 amino acids, 1 amino acid to about 65 amino acids, 1 amino acid to about 60 amino acids, 1 amino acid to about 55 amino acids, 1 amino acid to about 50 amino acids, 1 amino acid to about 45 amino acids, 1 amino acid to about 40 amino acids, 1 amino acid to about 35 amino acids, 1 amino acid to about 30 amino acids, 1 amino acid to about 25 amino acids, 1 amino acid to about 20 amino acids, 1 amino acid to about 15 amino acids, 1 amino acid to about 10 amino acids, 1 amino acid to about 9 amino acids, 1 amino acid to about 8 amino acids, 1 amino acid to about 7 amino acids, 1 amino acid to about 6 amino acids, 1 amino acid to about 5 amino acids, 1 amino acid to about 4 amino acids, 1 amino acid to about 3 amino acids, about 2 amino acids to about 100 amino acids, about 2 amino acid to about 95 amino acids, about 2 amino acids to about 90 amino acids, about 2 amino acids to about 85 amino acids, about 2 amino acids to about 80 amino acids, about 2 amino acids to about 75 amino acids, about 2 amino acids to about 70 amino acids, about 2 amino acids to about 65 amino acids, about 2 amino acids to about 60 amino acids, about 2 amino acids to about 55 amino acids, about 2 amino acids to about 50 amino acids, about 2 amino acids to about 45 amino acids, about 2 amino acids to about 40 amino acids, about 2 amino acids to about 35 amino acids, about 2 amino acids to about 30 amino acids, about 2 amino acids to about 25 amino acids, about 2 amino acids to about 20 amino acids, about 2 amino acids to about 15 amino acids, about 2 amino acids to about 10 amino acids, about 2 amino acids to about 9 amino acids, about 2 amino acids to about 8 amino acids, about 2 amino acids to about 7 amino acids, about 2 amino acids to about 6 amino acids, about 2 amino acids to about 5 amino acids, about 2 amino acids to about 4 amino acids, about 3 amino acids to about 100 amino acids, about 3 amino acid to about 95 amino acids, about 3 amino acids to about 90 amino acids, about 3 amino acids to about 85 amino acids, about 3 amino acids to about 80 amino acids, about 3 amino acids to about 75 amino acids, about 3 amino acids to about 70 amino acids, about 3 amino acids to about 65 amino acids, about 3 amino acids to about 60 amino acids, about 3 amino acids to about 55 amino acids, about 3 amino acids to about 50 amino acids, about 3 amino acids to about 45 amino acids, about 3 amino acids to about 40 amino acids, about 3 amino acids to about 35 amino acids, about 3 amino acids to about 30 amino acids, about 3 amino acids to about 25 amino acids, about 3 amino acids to about 20 amino acids, about 3 amino acids to about 15 amino acids, about 3 amino acids to about 10 amino acids, about 3 amino acids to about 9 amino acids, about 3 amino acids to about 8 amino acids, about 3 amino acids to about 7 amino acids, about 3 amino acids to about 6 amino acids, about 3 amino acids to about 5 amino acids, about 4 amino acids to about 100 amino acids, about 4 amino acid to about 95 amino acids, about 4 amino acids to about 90 amino acids, about 4 amino acids to about 85 amino acids, about 4 amino acids to about 80 amino acids, about 4 amino acids to about 75 amino acids, about 4 amino acids to about 70 amino acids, about 4 amino acids to about 65 amino acids, about 4 amino acids to about 60 amino acids, about 4 amino acids to about 55 amino acids, about 4 amino acids to about 50 amino acids, about 4 amino acids to about 45 amino acids, about 4 amino acids to about 40 amino acids, about 4 amino acids to about 35 amino acids, about 4 amino acids to about 30 amino acids, about 4 amino acids to about 25 amino acids, about 4 amino acids to about 20 amino acids, about 4 amino acids to about 15 amino acids, about 4 amino acids to about 10 amino acids, about 4 amino acids to about 9 amino acids, about 4 amino acids to about 8 amino acids, about 4 amino acids to about 7 amino acids, about 4 amino acids to about 6 amino acids, about 5 amino acids to about 100 amino acids, about 5 amino acid to about 95 amino acids, about 5 amino acids to about 90 amino acids, about 5 amino acids to about 85 amino acids, about 5 amino acids to about 80 amino acids, about 5 amino acids to about 75 amino acids, about 5 amino acids to about 70 amino acids, about 5 amino acids to about 65 amino acids, about 5 amino acids to about 60 amino acids, about 5 amino acids to about 55 amino acids, about 5 amino acids to about 50 amino acids, about 5 amino acids to about 45 amino acids, about 5 amino acids to about 40 amino acids, about 5 amino acids to about 35 amino acids, about 5 amino acids to about 30 amino acids, about 5 amino acids to about 25 amino acids, about 5 amino acids to about 20 amino acids, about 5 amino acids to about 15 amino acids, about 5 amino acids to about 10 amino acids, about 5 amino acids to about 9 amino acids, about 5 amino acids to about 8 amino acids, about 5 amino acids to about 7 amino acids, about 6 amino acids to about 100 amino acids, about 6 amino acid to about 95 amino acids, about 6 amino acids to about 90 amino acids, about 6 amino acids to about 85 amino acids, about 6 amino acids to about 80 amino acids, about 6 amino acids to about 75 amino acids, about 6 amino acids to about 70 amino acids, about 6 amino acids to about 65 amino acids, about 6 amino acids to about 60 amino acids, about 6 amino acids to about 55 amino acids, about 6 amino acids to about 50 amino acids, about 6 amino acids to about 45 amino acids, about 6 amino acids to about 40 amino acids, about 6 amino acids to about 35 amino acids, about 6 amino acids to about 30 amino acids, about 6 amino acids to about 25 amino acids, about 6 amino acids to about 20 amino acids, about 6 amino acids to about 15 amino acids, about 6 amino acids to about 10 amino acids, about 6 amino acids to about 9 amino acids, about 6 amino acids to about 8 amino acids, about 7 amino acids to about 100 amino acids, about 7 amino acid to about 95 amino acids, about 7 amino acids to about 90 amino acids, about 7 amino acids to about 85 amino acids, about 7 amino acids to about 80 amino acids, about 7 amino acids to about 75 amino acids, about 7 amino acids to about 70 amino acids, about 7 amino acids to about 65 amino acids, about 7 amino acids to about 60 amino acids, about 7 amino acids to about 55 amino acids, about 7 amino acids to about 50 amino acids, about 7 amino acids to about 45 amino acids, about 7 amino acids to about 40 amino acids, about 7 amino acids to about 35 amino acids, about 7 amino acids to about 30 amino acids, about 7 amino acids to about 25 amino acids, about 7 amino acids to about 20 amino acids, about 7 amino acids to about 15 amino acids, about 7 amino acids to about 10 amino acids, about 7 amino acids to about 9 amino acids, about 8 amino acids to about 100 amino acids, about 8 amino acid to about 95 amino acids, about 8 amino acids to about 90 amino acids, about 8 amino acids to about 85 amino acids, about 8 amino acids to about 80 amino acids, about 8 amino acids to about 75 amino acids, about 8 amino acids to about 70 amino acids, about 8 amino acids to about 65 amino acids, about 8 amino acids to about 60 amino acids, about 8 amino acids to about 55 amino acids, about 8 amino acids to about 50 amino acids, about 8 amino acids to about 45 amino acids, about 8 amino acids to about 40 amino acids, about 8 amino acids to about 35 amino acids, about 8 amino acids to about 30 amino acids, about 8 amino acids to about 25 amino acids, about 8 amino acids to about 20 amino acids, about 8 amino acids to about 15 amino acids, about 8 amino acids to about 10 amino acids, about 10 amino acids to about 100 amino acids, about 10 amino acid to about 95 amino acids, about 10 amino acids to about 90 amino acids, about 10 amino acids to about 85 amino acids, about 10 amino acids to about 80 amino acids, about 10 amino acids to about 75 amino acids, about 10 amino acids to about 70 amino acids, about 10 amino acids to about 65 amino acids, about 10 amino acids to about 60 amino acids, about 10 amino acids to about 55 amino acids, about 10 amino acids to about 50 amino acids, about 10 amino acids to about 45 amino acids, about 10 amino acids to about 40 amino acids, about 10 amino acids to about 35 amino acids, about 10 amino acids to about 30 amino acids, about 10 amino acids to about 25 amino acids, about 10 amino acids to about 20 amino acids, about 10 amino acids to about 15 amino acids, about 20 amino acids to about 100 amino acids, about 20 amino acid to about 95 amino acids, about 20 amino acids to about 90 amino acids, about 20 amino acids to about 85 amino acids, about 20 amino acids to about 80 amino acids, about 20 amino acids to about 75 amino acids, about 20 amino acids to about 70 amino acids, about 20 amino acids to about 65 amino acids, about 20 amino acids to about 60 amino acids, about 20 amino acids to about 55 amino acids, about 20 amino acids to about 50 amino acids, about 20 amino acids to about 45 amino acids, about 20 amino acids to about 40 amino acids, about 20 amino acids to about 35 amino acids, about 20 amino acids to about 30 amino acids, about 20 amino acids to about 25 amino acids, about 30 amino acids to about 100 amino acids, about 30 amino acid to about 95 amino acids, about 30 amino acids to about 90 amino acids, about 30 amino acids to about 85 amino acids, about 30 amino acids to about 80 amino acids, about 30 amino acids to about 75 amino acids, about 30 amino acids to about 70 amino acids, about 30 amino acids to about 65 amino acids, about 30 amino acids to about 60 amino acids, about 30 amino acids to about 55 amino acids, about 30 amino acids to about 50 amino acids, about 30 amino acids to about 45 amino acids, about 30 amino acids to about 40 amino acids, about 30 amino acids to about 35 amino acids, about 40 amino acids to about 100 amino acids, about 40 amino acid to about 95 amino acids, about 40 amino acids to about 90 amino acids, about 40 amino acids to about 85 amino acids, about 40 amino acids to about 80 amino acids, about 40 amino acids to about 75 amino acids, about 40 amino acids to about 70 amino acids, about 40 amino acids to about 65 amino acids, about 40 amino acids to about 60 amino acids, about 40 amino acids to about 55 amino acids, about 40 amino acids to about 50 amino acids, about 40 amino acids to about 45 amino acids, about 50 amino acids to about 100 amino acids, about 50 amino acid to about 95 amino acids, about 50 amino acids to about 90 amino acids, about 50 amino acids to about 85 amino acids, about 50 amino acids to about 80 amino acids, about 50 amino acids to about 75 amino acids, about 50 amino acids to about 70 amino acids, about 50 amino acids to about 65 amino acids, about 50 amino acids to about 60 amino acids, about 50 amino acids to about 55 amino acids, about 60 amino acids to about 100 amino acids, about 60 amino acid to about 95 amino acids, about 60 amino acids to about 90 amino acids, about 60 amino acids to about 85 amino acids, about 60 amino acids to about 80 amino acids, about 60 amino acids to about 75 amino acids, about 60 amino acids to about 70 amino acids, about 60 amino acids to about 65 amino acids, about 70 amino acids to about 100 amino acids, about 70 amino acid to about 95 amino acids, about 70 amino acids to about 90 amino acids, about 70 amino acids to about 85 amino acids, about 70 amino acids to about 80 amino acids, about 70 amino acids to about 75 amino acids, about 80 amino acids to about 100 amino acids, about 80 amino acid to about 95 amino acids, about 80 amino acids to about 90 amino acids, about 80 amino acids to about 85 amino acids, about 90 amino acids to about 100 amino acids, about 90 amino acids to about 95 amino acids, or about 95 amino acids to about 100 amino acids, removed from its N-terminus and/or from its C-terminus.

In some embodiments, an active otoferlin protein can, e.g., include the sequence of a wildtype, full-length otoferlin protein where 1 amino acid to 50 amino acids, 1 amino acid to 45 amino acids, 1 amino acid to 40 amino acids, 1 amino acid to 35 amino acids, 1 amino acid to 30 amino acids, 1 amino acid to 25 amino acids, 1 amino acid to 20 amino acids, 1 amino acid to 15 amino acids, 1 amino acid to 10 amino acids, 1 amino acid to 9 amino acids, 1 amino acid to 8 amino acids, 1 amino acid to 7 amino acids, 1 amino acid to 6 amino acids, 1 amino acid to 5 amino acids, 1 amino acid to 4 amino acids, 1 amino acid to 3 amino acids, about 2 amino acids to 50 amino acids, about 2 amino acids to 45 amino acids, about 2 amino acids to 40 amino acids, about 2 amino acids to 35 amino acids, about 2 amino acids to 30 amino acids, about 2 amino acids to 25 amino acids, about 2 amino acids to 20 amino acids, about 2 amino acids to 15 amino acids, about 2 amino acids to 10 amino acids, about 2 amino acids to 9 amino acids, about 2 amino acids to 8 amino acids, about 2 amino acids to 7 amino acids, about 2 amino acids to 6 amino acids, about 2 amino acids to 5 amino acids, about 2 amino acids to 4 amino acids, about 3 amino acids to 50 amino acids, about 3 amino acids to 45 amino acids, about 3 amino acids to 40 amino acids, about 3 amino acids to 35 amino acids, about 3 amino acids to 30 amino acids, about 3 amino acids to 25 amino acids, about 3 amino acids to 20 amino acids, about 3 amino acids to 15 amino acids, about 3 amino acids to 10 amino acids, about 3 amino acids to 9 amino acids, about 3 amino acids to 8 amino acids, about 3 amino acids to 7 amino acids, about 3 amino acids to 6 amino acids, about 3 amino acids to 5 amino acids, about 4 amino acids to 50 amino acids, about 4 amino acids to 45 amino acids, about 4 amino acids to 40 amino acids, about 4 amino acids to 35 amino acids, about 4 amino acids to 30 amino acids, about 4 amino acids to 25 amino acids, about 4 amino acids to 20 amino acids, about 4 amino acids to 15 amino acids, about 4 amino acids to 10 amino acids, about 4 amino acids to 9 amino acids, about 4 amino acids to 8 amino acids, about 4 amino acids to 7 amino acids, about 4 amino acids to 6 amino acids, about 5 amino acids to 50 amino acids, about 5 amino acids to 45 amino acids, about 5 amino acids to 40 amino acids, about 5 amino acids to 35 amino acids, about 5 amino acids to 30 amino acids, about 5 amino acids to 25 amino acids, about 5 amino acids to 20 amino acids, about 5 amino acids to 15 amino acids, about 5 amino acids to 10 amino acids, about 5 amino acids to 9 amino acids, about 5 amino acids to 8 amino acids, about 5 amino acids to 7 amino acids, about 6 amino acids to 50 amino acids, about 6 amino acids to 45 amino acids, about 6 amino acids to 40 amino acids, about 6 amino acids to 35 amino acids, about 6 amino acids to 30 amino acids, about 6 amino acids to 25 amino acids, about 6 amino acids to 20 amino acids, about 6 amino acids to 15 amino acids, about 6 amino acids to 10 amino acids, about 6 amino acids to 9 amino acids, about 6 amino acids to 8 amino acids, about 7 amino acids to 50 amino acids, about 7 amino acids to 45 amino acids, about 7 amino acids to 40 amino acids, about 7 amino acids to 35 amino acids, about 7 amino acids to 30 amino acids, about 7 amino acids to 25 amino acids, about 7 amino acids to 20 amino acids, about 7 amino acids to 15 amino acids, about 7 amino acids to 10 amino acids, about 7 amino acids to 9 amino acids, about 8 amino acids to 50 amino acids, about 8 amino acids to 45 amino acids, about 8 amino acids to 40 amino acids, about 8 amino acids to 35 amino acids, about 8 amino acids to 30 amino acids, about 8 amino acids to 25 amino acids, about 8 amino acids to 20 amino acids, about 8 amino acids to 15 amino acids, about 8 amino acids to 10 amino acids, about 10 amino acids to 50 amino acids, about 10 amino acids to 45 amino acids, about 10 amino acids to 40 amino acids, about 10 amino acids to 35 amino acids, about 10 amino acids to 30 amino acids, about 10 amino acids to 25 amino acids, about 10 amino acids to 20 amino acids, about 10 amino acids to 15 amino acids, about 15 amino acids to 50 amino acids, about 15 amino acids to 45 amino acids, about 15 amino acids to 40 amino acids, about 15 amino acids to 35 amino acids, about 15 amino acids to 30 amino acids, about 15 amino acids to 25 amino acids, about 15 amino acids to 20 amino acids, about 20 amino acids to 50 amino acids, about 20 amino acids to 45 amino acids, about 20 amino acids to 40 amino acids, about 20 amino acids to 35 amino acids, about 20 amino acids to 30 amino acids, about 20 amino acids to 25 amino acids, about 25 amino acids to 50 amino acids, about 25 amino acids to 45 amino acids, about 25 amino acids to 40 amino acids, about 25 amino acids to 35 amino acids, about 25 amino acids to 30 amino acids, about 30 amino acids to 50 amino acids, about 30 amino acids to 45 amino acids, about 30 amino acids to 40 amino acids, about 30 amino acids to 35 amino acids, about 35 amino acids to 50 amino acids, about 35 amino acids to 45 amino acids, about 35 amino acids to 40 amino acids, about 40 amino acids to 50 amino acids, about 40 amino acids to 45 amino acids, or about 45 amino acids to about 50 amino acids, are inserted. In some examples, the inserted amino acid(s) can be inserted as a contiguous sequence into the sequence of a wildtype, full-length protein. In some examples, the amino acid(s) are not inserted as a contiguous sequence into the sequence of a wildtype, full-length protein. As can be appreciated in the art, the amino acid(s) can be inserted into a portion of the sequence of a wildtype, full-length protein that is not well-conserved between species.

Ranges: throughout this disclosure, various aspects of the disclosure can be presented in a range format. It should be understood that the description in range format is merely for convenience and brevity and should not be construed as an inflexible limitation on the scope of the disclosure. Accordingly, the description of a range should be considered to have specifically disclosed all the possible subranges as well as individual numerical values within that range. For example, description of a range such as from 1 to 6 should be considered to have specifically disclosed subranges such as from 1 to 3, from 1 to 4, from 1 to 5, from 2 to 4, from 2 to 6, from 3 to 6 etc., as well as individual numbers within that range, for example, 1, 2, 2.7, 3, 4, 5, 5.3, and 6. As another example, a range such as 95-99% identity includes something with 95%, 96%, 97%, 98% or 99% identity, and includes subranges such as 96-99%, 96-98%, 96-97%, 97-99%, 97-98% and 98-99% identity. This applies regardless of the breadth of the range.

In one aspect the present disclosure provides a recombinant AAV vector of SEQ ID NO: 96. In one aspect the present disclosure provides a recombinant AAV vector of SEQ ID NO: 105.

In one aspect the present disclosure provides a recombinant AAV vector that comprises, in order of 5' to 3': a 5' ITR sequence of SEQ ID NO: 97; a CAG promoter comprising a CMV early enhancer element of SEQ ID NO: 98, a chicken beta actin gene sequence of SEQ ID NO: 99, and a chimeric intron of SEQ ID NO: 100; a 5'OTOF coding region that comprises exons 1 to (and through) 21 of OTOF cDNA; a SD intron sequence of SEQ ID NO: 102; an AK recombinogenic sequence of SEQ ID NO: 103; and a 3' ITR sequence of SEQ ID NO: 104. In some embodiments, the 5'OTOF coding region is SEQ ID NO: 101. In some embodiments, the 5'OTOF coding region is at least 70%, at least 80%, at least 90%, at least 91%, at least 92%, at least 93%, at least 94%, at least 95%, at least 96%, at least 97%, at least 98%, at least 99%, at least 99.5%, at least 99.9% or 100% identical to SEQ ID NO: 101, and encodes the same amino acid sequence as encoded by SEQ ID NO: 101.

In one aspect the present disclosure provides a recombinant AAV vector that comprises, in order of 5' to 3': a 5' ITR sequence of SEQ ID NO: 97; an AK recombinogenic sequence of SEQ ID NO: 103; a SA intron sequence of SEQ ID NO: 106; a 3' OTOF coding region that comprises exons 22 to (and through) exon 48 of OTOF cDNA; a bgH polyA sequence of SEQ ID NO: 108; and a 3' ITR sequence of SEQ ID NO: 104. In some embodiments, the 3'OTOF coding region is SEQ ID NO: 107. In some embodiments, the 3'OTOF coding region is at least 70%, at least 80%, at least 90%, at least 91%, at least 92%, at least 93%, at least 94%, at least 95%, at least 96%, at least 97%, at least 98%, at least 99%, at least 99.5%, at least 99.9% or 100% identical to SEQ ID NO: 107, and encodes the same amino acid sequence as encoded by SEQ ID NO: 107.

In one aspect the present disclosure provides an rAAV particle comprising one of the aforementioned recombinant AAV vectors encapsidated by an Anc80 capsid. In some embodiment, the Anc80 capsid comprises a polypeptide of SEQ ID NO: 109. In one aspect the present disclosure provides a composition comprising a first rAAV particle comprising a recombinant AAV vector of SEQ ID NO: 96 and a second rAAV particle comprising a recombinant AAV vector of SEQ ID NO: 105. In some embodiments the recombinant AAV vector of the first rAAV particle is encapsidated by an Anc80 capsid. In some embodiments the recombinant AAV vector of the second rAAV particle is encapsidated by an Anc80 capsid. In some embodiments the recombinant AAV vectors of the first and second rAAV particles are each independently encapsidated by an Anc80 capsid. In some embodiment, the Anc80 capsid comprises a polypeptide of SEQ ID NO: 109.

In one aspect the present disclosure provides a composition comprising (a) a first rAAV particle comprising a recombinant AAV vector that comprises, in order of 5' to 3': a 5' ITR sequence of SEQ ID NO: 97; a CAG promoter comprising a CMV early enhancer element of SEQ ID NO: 98, a chicken beta actin gene sequence of SEQ ID NO: 99, and a chimeric intron of SEQ ID NO: 100; a 5'OTOF coding region that comprises exons 1 to (and through) 21 of OTOF cDNA; a SD intron sequence of SEQ ID NO: 102; an AK recombinogenic sequence of SEQ ID NO: 103; and a 3' ITR sequence of SEQ ID NO: 104; and (b) a second rAAV particle comprising a recombinant AAV vector that comprises a 5' ITR sequence of SEQ ID NO: 97; an AK recombinogenic sequence of SEQ ID NO: 103; a SA intron sequence of SEQ ID NO: 106; a 3' OTOF coding region that comprises exons 22 to (and through) exon 48 of OTOF cDNA; a bgH polyA sequence of SEQ ID NO: 108; and a 3' ITR sequence of SEQ ID NO: 104. In some embodiments, the 5'OTOF coding region is SEQ ID NO: 101. In some embodiments, the 5'OTOF coding region is at least 70% identical to SEQ ID NO: 101, and encodes the same amino acid sequence as SEQ ID NO: 101. In some embodiments, the 3'OTOF coding region is SEQ ID NO: 107. In some embodiments, the 3'OTOF coding region is at least 70%, at least 80%, at least 90%, at least 91%, at least 92%, at least 93%, at least 94%, at least 95%, at least 96%, at least 97%, at least 98%, at least 99%, at least 99.5%, at least 99.9% or 100% identical to SEQ ID NO: 107, and encodes the same amino acid sequence as encoded by SEQ ID NO: 107. In some embodiments the recombinant AAV vectors in the first and second rAAV particles are each independently encapsidated by an Anc80 capsid. In some embodiment, the Anc80 capsid comprises a polypeptide of SEQ ID NO: 109.

In one aspect when the aforementioned composition is introduced into a human cell the recombinant AAV vectors of the first and second rAAV particles undergo concatamerization or homologous recombination with each other, thereby forming a recombined nucleic acid that encodes a full-length otoferlin protein within the cell.

In one aspect the present disclosure provides a method comprising introducing into a cochlea of a mammal (e.g., a human) a therapeutically effective amount of any of the aforementioned composition. In some embodiments, the mammal has been previously identified as having a defective otoferlin gene.

In one aspect the present disclosure provides a method of increasing expression of a full-length otoferlin protein in a mammalian cell, the method comprising introducing any of the aforementioned compositions into the mammalian cell, e.g., an inner hair cell, e.g., a human cell. In some embodiments, the mammalian cell has previously been determined to have a defective otoferlin gene.

In one aspect the present disclosure provides a method of increasing expression of a full-length otoferlin protein in an inner hair cell in a cochlea of a mammal, e.g., a human, the method comprising introducing into the cochlea of the mammal a therapeutically effective amount of any of the aforementioned compositions. In some embodiments, the mammal has been previously identified as having a defective otoferlin gene.

In one aspect the present disclosure provides a method of treating non-symptomatic sensorineural hearing loss in a subject, e.g., a human identified as having a defective otoferlin gene, the method comprising administering a therapeutically effective amount of any of the aforementioned compositions into the cochlea of the subject. In some embodiments, the method further comprises, prior to the administering step, determining that the subject has a defective otoferlin gene. In some embodiments the composition is administered to the cochlea using a microcatheter. In some embodiments the microcatheter is shaped such that it can enter the middle ear cavity via the external auditory canal and contact the end of the microcatheter with the RWM. In some embodiments the distal end of the microcatheter is comprised of at least one microneedle with diameter of between 10 and 1,000 microns.

In one aspect the present disclosure provides a kit comprising any of the aforementioned compositions. In some embodiments the composition is pre-loaded in a device, e.g., a microcatheter. In some embodiments the microcatheter is shaped such that it can enter the middle ear cavity via the external auditory canal and contact the end of the microcatheter with the RWM. In some embodiments the distal end of the microcatheter is comprised of at least one microneedle with diameter of between 10 and 1,000 microns.

Unless otherwise defined, all technical and scientific terms used herein have the same meaning as commonly understood by one of ordinary skill in the art to which this disclosure belongs. Methods and materials are described herein for use in the present disclosure; other suitable methods and materials known in the art can also be used. The materials, methods, and examples are illustrative only and not intended to be limiting. All publications, patent applications, patents, sequences, database entries, and other references mentioned herein are incorporated by reference in their entirety. In case of conflict, the present specification, including definitions, will control.

DETAILED DESCRIPTION

Mutations in OTOF lead to DFNB9, a recessively inherited, non-syndromic prelingual hearing disorder. Deficiency in otoferlin, the protein encoded by OTOF, abolishes fast exocytosis from auditory inner hair cells (IHCs). Due the impairment of neurotransmission at the first auditory synapse, no sound signals are transmitted to the brain, explaining the profound deafness.

The presently claimed methods were discovered to result in expression of full-length otoferlin in inner auditory hair cells and to successfully restore hearing with ABR thresholds of 30 dB to 70 dB for click stimuli and 50 dB to 90 dB for pure tones in otoferlin knock-out mice. In view of this discovery, provided herein are compositions and methods for treating non-symptomatic sensorineural hearing loss in a subject (e.g., a human) identified as having a defective otoferlin gene.

Provided herein are compositions that include at least two different nucleic acid vectors, where: each of the at least two different vectors includes a coding sequence that encodes a different portion of an otoferlin protein, each of the encoded portions being at least 30 amino acid residues in length, where the amino acid sequence of each of the encoded portions may optionally partially overlap with the amino acid sequence of a different one of the encoded portions; no single vector of the at least two different vectors encodes an active otoferlin protein (e.g., a full-length otoferlin protein); at least one of the coding sequences comprises a nucleotide sequence spanning two neighboring exons of otoferlin genomic DNA, and lacks an intronic sequence between the two neighboring exons; and, when introduced into a mammalian cell, the at least two different vectors undergo homologous recombination with each other, thereby forming a recombined nucleic acid, where the recombined nucleic acid encodes an active otoferlin protein (e.g., a full-length otoferlin protein). In some examples, the recombined nucleic acid that encodes an active otoferlin protein (e.g., a full-length otoferlin protein) exists as an episome in a mammalian cell (e.g., any of the types of mammalian cells described herein). Also provided are kits that include any of the compositions described herein. Also provided herein are methods that include introducing into a cochlea of a mammal a therapeutically effective amount of any of the compositions described herein.

Also provided herein are methods of increasing expression of an active otoferlin protein (e.g., a full-length otoferlin protein) in a mammalian cell that include introducing any of the compositions described herein into the mammalian cell. Also provided herein are methods of increasing expression of an active otoferlin protein (e.g., a full-length otoferlin protein) in an inner hair cell in a cochlea of a mammal that include introducing into the cochlea of the mammal a therapeutically effective amount of any of the compositions described herein. Also provided herein are methods of treating non-symptomatic sensorineural hearing loss in a subject identified as having a defective otoferlin gene that include: administering a therapeutically effective amount of any of the compositions described herein into the cochlea of the subject.

Additional non-limiting aspects of the compositions, kits, and methods are described herein and can be used in any combination without limitation.

Otoferlin

The human OTOF gene encodes otoferlin, which is a protein that, in some embodiments, plays a critical role in priming, fusion, and/or replenishing of synaptic vesicles of inner hair cell synapses during sound encoding. To date, several hundred mutations in the human OTOF gene have been identified to cause profound prelingual deafness DFNB9. Such mutations are the cause of deafness in 2-8% of people that are born with an autosomal, recessively inherited, non-syndromic deafness in different populations (Rodriguez-Ballesteros et al. (2008) Hum. Mutat. 29 823-831; Choi et al. (2009) Clinical Genetics 75 237-243; Duman et al. (2011) Genet Test Mol Biomarkers 15 29-33; Varga et al. (2006) J Med Genet 43 576-581; Iwasa et al. (2013) BMC Med. Genet. 14 95). Biallelic otoferlin gene mutations cause localized, synaptic transmission defects between hair cells and the auditory nerve. Otoferlin enables sensory cells to release neurotransmitters in response to stimulation by sound to activate auditory neurons and those neurons carry electronically encoded acousting information to the brain to produce "hearing." When biallelic mutations in OTOF are present, that transmission is impaired and, as a result, a majority of subjects have congenital, severe to profound sensorineural hearing loss. For example, two substitutions in exon 15 at positions 490 and 515 in the conserved C2C domain of otoferlin cause DFNB9 (Mirqhomizadeh et al. (2002) Neurobiol. Dis. 10(2): 157-164). Migliosi et al. found a novel mutation Q829X in OTOF in Spanish subjects with prelingual non-syndromic hearing loss (Migliosi et al. (2002) J. Med. Genet. 39(7): 502-506).

Additional exemplary mutations in a otoferlin gene detected in subjects having hearing loss and methods of sequencing a nucleic acid encoding otoferlin are described in, e.g., Rodriguez-Ballesteros et al. (2003) Hum Mutat. 22: 451-456; Wang et al. (2010) BMC Med Genet. 11:79; Yildirim-Baylan et al. (2014) Int. J. Pediatr. Otorhinolaryngol 78: 950-953; Choi et al. (2009) Clin. Genet. 75(3): 237-243; and Marlin et al. (2010) Biochem Biophys Res Commun 394: 737-742.

Otoacoustic emissions from DFNB9 subjects are normal, at least for the first decade of life, indicating morphological integrity of the inner ear and proper function of outer hair cells. Apart from the lack of synaptic transmission and the subsequent loss of synapses, the morphology and physiology of the inner ear remains preserved in DFNB9, at least during the first decade in life in humans. Accordingly, in some embodiments, restoration of OTOF and/or otoferlin function may serve to mitigate or prevent secondary degeneration of one or more cochlear structures.

Studies in mouse models revealed that synapses are structurally normal, and IHCs preserve normal synapse numbers in mice within the first postnatal week. Between P6 and P15, about half of the synapses get lost (Roux et al. (2006) Cell 127 277-289). Animal models allowed studying the effect of mutations in otoferlin on synaptic transmission by recording the change in plasma membrane capacitance after vesicle fusion and the activity in the auditory nerve. In otoferlin knock-out (Otof−/−) mice, almost no exocytosis could be triggered in IHCs by depolarization induced Ca2+ influx through voltage gated Ca2+ channels (Roux et al. (2006) Cell 127 277-289). In profoundly hearing impaired pachanga (OtofPga/Pga) mice with a random point mutation in the C2F domain, short (<10 ms) depolarizations of the IHCs elicited vesicle fusion of similar size as in wild type mice, however sustained stimulations uncovered a strong deficiency in replenishing vesicles to the readily releasable pool (Pangrsic et al. (2010) Nat. Neurosci. 13 869-876). The p.Ile515Thr mutation, found in human subjects with only mildly elevated hearing thresholds but a severe reduction in speech understanding and a temperature-dependent deafening (Varga et al. (2006) J Med Genet 43 576-581), uncovered an intermediate phenotype when studied in a mouse model (Strenzke et al. (2016) EMBO J. 35:2519-2535). These OtofI515T/I515T mice showed a moderate elevation of hearing thresholds when assessed by ABR with a reduction in wave I amplitude, but normal auditory thresholds in behavioral tests and recordings of single auditory nerve units. Exocytosis of the RRP is again intact, but sustained exocytosis is reduced, although not as severe as in OtofPga/Pga. While in wild type mice at room temperature, during a sustained stimulus 750 vesicles can fuse per second at each active zone, this rate drops to 350 vesicles/s/active zone in OtofJ515T/I515T mice and to 200 vesicles/s/active zone in OtofPga/Pga IHCs (Pangrsic et al. (2010) Nat. Neurosci. 13 869-876; Strenzke et al. (2016) EMBO J. 35 2519-2535). This correlated with lower otoferlin protein levels at the plasma membrane of IHCs, indicating that the amount of otoferlin scales with exocytosis and hearing (Strenzke et al. (2016) EMBO J. 35 2519-2535).

Methods of detecting mutations in a gene are well-known in the art. Non-limiting examples of such techniques include: real-time polymerase chain reaction (RT-PCR), PCR, sequencing, Southern blotting, and Northern blotting.

The OTOF gene encodes otoferlin, a protein that is involved in synaptic vesicle exocytosis in cochlear hair cells (see, e.g., Johnson and Chapman (2010) J. Cell Biol. 191 (1):187-198; and Heidrych et al. (2008) Hum. Mol. Genet. 17:3814-3821).

The human OTOF gene is located on chromosome 2p23.3. It contains 48 exons encompassing ~132 kilobases (kb) (NCBI Accession No. NG009937.1). The mRNA encoding the long-form of otoferlin expressed in the brain includes 48 exons (Yasunaga et al., *Am. J. Hum. Genet.* 67:591-600, 2000). Forward and reverse primers that can be used to amplify each of the 48 exons in the OTOF gene are described in Table 2 of Yasunaga et al., *Am. J. Hum. Genet.* 67:591-600, 2000. In some examples, the full-length OTOF protein is a full-length wildtype OTOF protein. The full-length wildtype OTOF protein expressed from the human OTOF gene is 1997 residues in length.

An exemplary human wildtype otoferlin protein is or includes the sequence of any one of SEQ ID NOs: 1-5. Isoform e of human otoferlin protein (SEQ ID NO: 5) is encoded by an mRNA that includes exon 48 and does not include exon 47 of the otoferlin gene (Yasunaga et al., *Am. J. Hum. Genet.* 67:591-600, 2000). In some embodiments, the active otoferlin protein has the sequence of SEQ ID NO: 5, but is missing the 20 amino acids including the RXR motif identified in Strenzke et al., *EMBO J.* 35(23):2499-2615, 2016. Non-limiting examples of nucleic acids encoding a wildtype otoferlin protein are or include any one of SEQ ID NO: 7-11. As can be appreciated in the art, at least some or all of the codons in SEQ ID NO: 7-11 can be codon-optimized to allow for optimal expression in a non-human mammal or in a human. Orthologs of human otoferlin proteins are known in the art.

Human Otoferlin Protein cDNA Sequences:
Human canonical (long) isoform sequence (otoferlin protein) (SEQ ID NO: 1) (also called otoferlin isoform a) (NCBI Accession No. AAD26117.1)
Human Isoform 2 (short 1) (otoferlin protein) (SEQ ID NO: 2) (also called otoferlin isoform d) (NCBI Accession No. NP_919304.1)
Human Isoform 3 (short 2) (otoferlin protein) (SEQ ID NO: 3) (also called otoferlin isofom c) (NCBI Accession No. NP_919303.1)
Human Isoform 4 (short 3) (otoferlin protein) (SEQ ID NO: 4) (also called otoferlin isoform b) (NCBI Accession No. NP_004793.2)
Human Isoform 5 (short 4) (otoferlin protein) (SEQ ID NO: 5) (also called otoferlin isoform e) (NCBI Accession No. NP_001274418.1)
Complete cds (otoferlin cDNA) (www.ncbi.nlm.nih.gov/nuccore/AF107403.1) (SEQ ID NO: 6) (encodes the protein of SEQ ID NO: 1)
Human Otoferlin Transcript Variant 1 (www.ncbi.nlm.nih.gov/nuccore/NM_194248.2) (SEQ ID NO: 7) (encodes the protein of SEQ ID NO: 1)
Human Otoferlin Transcript Variant 2 (www.ncbi.nlm.nih.gov/nuccore/NM_004802.3) (SEQ ID NO: 8) (encodes the protein of SEQ ID NO: 4)
Human Otoferlin Transcript Variant 3 (www.ncbi.nlm.nih.gov/nuccore/NM_194322.2) (SEQ ID NO: 9) (encodes the protein of SEQ ID NO: 3)
Human Otoferlin Transcript Variant 4 (www.ncbi.nlm.nih.gov/nuccore/NM_194323.2) (SEQ ID NO: 10) (encodes the protein of SEQ ID NO: 2)
Human Otoferlin Transcript Variant 5 (www.ncbi.nlm.nih.gov/nuccore/NM_001287489.1) (SEQ ID NO: 11) (encodes the protein of SEQ ID NO: 5)

A non-limiting example of a human wildtype otoferlin genomic DNA sequence is SEQ ID NO: 12. The exons in SEQ ID NO: 12 are: nucleotide positions 5001-5206 (exon 1), nucleotide positions 25925-25983 (exon 2), nucleotide positions 35779-35867 (exon 3), nucleotide positions 44590-44689 (exon 4), nucleotide positions 47100-47281 (exon 5), nucleotide positions 59854-59927 (exon 6), nucleotide positions 61273-61399 (exon 7), nucleotide positions 61891-61945 (exon 8), nucleotide positions 68626-68757(exon 9), nucleotide positions 73959-74021 (exon 10), nucleotide positions 74404-74488 (exon 11), nucleotide positions 79066-79225 (exon 12), nucleotide positions 80051-80237 (exon 13), nucleotide positions 81107-81293 (exon 14), nucleotide positions 82690-82913 (exon 15), nucleotide positions 83388-83496 (exon 16), nucleotide positions 84046-84226 (exon 17), nucleotide positions 84315-84435 (exon 18), nucleotide positions 85950-86050 (exon 19), nucleotide positions 86193-86283 (exon 20), nucleotide positions 86411-86527 (exon 21), nucleotide positions 86656-86808 (exon 22), nucleotide positions 87382-87571 (exon 23), nucleotide positions 87661-87785 (exon 24), nucleotide positions 88206-88340 (exon 25), nucleotide positions 89025-89186 (exon 26), nucleotide positions 89589-89708 (exon 27), nucleotide positions 90132-90293 (exon 28), nucleotide positions 90405-90567 (exon 29), nucleotide positions 91050-91180 (exon 30), nucleotide positions 92549-92578 (exon 31), nucleotide positions 92978-93106 (exon 32), nucleotide positions 95225-95291 (exon 33), nucleotide positions 96198-96334 (exon 34), nucleotide positions 96466-96600 (exon 35), nucleotide positions 96848-96985 (exon 36), nucleotide positions 97623-97750 (exon 37), nucleotide positions 97857-98027 (exon 38), nucleotide positions 98670-98830 (exon 39), nucleotide positions 99593-99735 (exon 40), nucleotide positions 100128-100216 (exon 41), nucleotide positions 101518-101616 (exon 42), nucleotide positions 101762-102003 (exon 43), nucleotide positions 102669-102847 (exon 44), nucleotide positions 102952-103052 (exon 45), nucleotide positions 103494-103691 (exon 46), nucleotide positions 105479-106496 (exon 47), and exon 48 (the sequence starting with CCGGCCCGAC; see also the description of this exon in Yasunaga et al., Am. J. Hum. Genet. 67:591-600, 2000).

The introns are located between each contiguous pair of exons in SEQ ID NO: 12, i.e., at nucleotide positions 100-5001 (intron 1), nucleotide 5207-25924 (intron 2), nucleotide positions 25984-35778 (intron 3), nucleotide positions 35868-44589 (intron 4), nucleotide positions 44690-47099 (intron 5), nucleotide positions 47282-59853 (intron 6), nucleotide positions 59928-61272 (intron 7), nucleotide positions 61400-61890 (intron 8), nucleotide positions 61946-68625 (intron 9), nucleotide positions 68758-73958 (intron 10), nucleotide positions 74022-74403 (intron 11), nucleotide positions 74489-79065 (intron 12), nucleotide positions 79226-80050 (intron 13), nucleotide positions 80238-81106 (intron 14), nucleotide positions 81294-82689 (intron 15), nucleotide positions 82914-83387 (intron 16), nucleotide positions 83497-84045 (intron 17), nucleotide positions 84227-84314 (intron 18), nucleotide positions 84436-85949 (intron 19), nucleotide positions 86051-86192 (intron 20), nucleotide positions 86284-86410

(intron 21), nucleotide positions 86528-86655 (intron 22), nucleotide positions 86809-87381 (intron 23), nucleotide positions 87572-87660 (intron 24), nucleotide positions 87786-88205 (intron 25), nucleotide positions 88341-89024 (intron 26), nucleotide positions 89187-89588 (intron 27), nucleotide positions 89709-90131 (intron 28), nucleotide positions 90294-90404 (intron 29), nucleotide positions 90568-91049 (intron 30), nucleotide positions 91181-92548 (intron 31), nucleotide positions 92579-92977 (intron 32), nucleotide positions 93107-95224 (intron 33), nucleotide positions 95292-96197 (intron 34), nucleotide positions 96335-96465 (intron 35), nucleotide positions 96601-96847 (intron 36), nucleotide positions 96986-97622 (intron 37), nucleotide positions 97751-97856 (intron 38), nucleotide positions 98028-98669 (intron 39), nucleotide positions 98831-99592 (intron 40), nucleotide positions 99736-100127 (intron 41), nucleotide positions 100217-101517 (intron 42), nucleotide positions 101617-101761 (intron 43), nucleotide positions 102004-102668 (intron 44), nucleotide positions 102848-102951 (intron 45), nucleotide positions 103053-103494 (intron 46), nucleotide positions 103692-105478 (intron 47), and nucleotide positions 106497-108496 (intron 48).

In some embodiments, an otoferlin gene may be split into two or more segments between or within any appropriate exons and/or introns, where each segment is included in a different vector of the present disclosure. In some embodiments, the otoferlin gene is split at exon 21, i.e., with exons 1 to (and through) 21 in a first vector and exons 22 to (and through) exon 48 in a second vector. In some such embodiments the otoferlin segments in the first and second vectors are derived from an otoferlin cDNA sequence and lack introns, i.e., with exons 1 to (and through) 21 in a first vector and exons 22 to (and through) exon 48 in a second vector, each vector lacking otoferlin introns. In some embodiments, an otoferlin gene may be split at one or more other exons and/or introns as long as, when combined with all other components of a vector, the packaging capacity of the vector is not exceeded.

Human Otoferlin Gene Sequence (ncbi.nlm.nih.gov/nuccore/224465243) (SEQ ID NO: 12)
Mouse Otoferlin Protein (SEQ ID NO: 13) (NCBI Accession No. NP_001300696.1)
Mouse Otoferlin cDNA (SEQ ID NO: 14) (NCBI Accession No. NM_001313767.1)
Mouse Otoferlin Gene Sequence (www.ncbi.nlm.nih.gov/gene/83762) (SEQ ID NO: 15) Accession: NC_000071 REGION: complement(30367066 . . . 30462730) GPC_000000778; NCBI Reference Sequence: NC_000071.6
Zebrafish Otoferlin A Gene Sequence (www.ncbi.nlm.nih.gov/gene/557476) (SEQ ID NO: 16) ACCESSION NC_007131 REGION: 31173357.31310109 GPC_000001574 NCBI Reference Sequence: NC 007131.7
Rhesus Monkey Otoferlin Gene Sequence (www.ncbi.nlm.nih.gov/gene/696717) (SEQ ID NO: 17) ACCESSION NC_027905 REGION: complement(26723411 . . . 26826586) GPC_000002105 NCBI Reference Sequence: NC_027905.1
Dog Otoferlin Gene Sequence (www.ncbi.nlm.nih.gov/gene/607961) (SEQ ID NO: 18) ACCESSION NC_006599 REGION: complement(20518502 . . . 20619461) GPC_000000676 NCBI Reference Sequence: NC_006599.3
Chimpanzee Otoferlin Gene Sequence (www.ncbi.nlm.nih.gov/gene/459083) (SEQ ID NO: 19) ACCESSION NC_006469 REGION: complement(27006052 . . . 27107747) GPC_000002338 NCBI Reference Sequence: NC_006469.4
Rat Otoferlin Protein (SEQ ID NO: 20)
Zebrafish Otoferlin Protein (SEQ ID NO: 21)
Cow Otoferlin Protein (SEQ ID NO: 22)
Baboon Otoferlin Protein (SEQ ID NO: 23)

In some embodiments, a first vector comprises a 5' portion of OTOF cDNA, e.g., as shown in SEQ ID NO: 94. In some embodiments, a second vector comprises a 3' portion of OTOF cDNA, e.g., as shown in SEQ ID NO: 95.

```
5'mOTOF DNA Sequence
                                      (SEQ ID NO: 94)
ATGGCCCTGATTGTTCACCTCAAGACTGTCTCAGAGCTCCGAGGC

AAAGGTGACCGGATTGCCAAAGTCACTTTCCGAGGGCAGTCTTTC

TACTCCCGGGTCCTGGAGAACTGCGAGGGTGTGGCTGACTTTGAT

GAGACGTTCCGGTGGCCAGTGGCCAGCAGCATCGACCGGAATGAA

GTGTTGGAGATTCAGATTTTCAACTACAGCAAAGTCTTCAGCAAC

AAGCTGATAGGGACCTTCTGCATGGTGCTGCAGAAAGTGGTGGAG

GAGAATCGGGTAGAGGTGACCGACACGCTGATGGATGACAGCAAT

GCTATCATCAAGACCAGCCTGAGCATGGAGGTCCGGTATCAGGCC

ACAGATGGCACTGTGGGCCCCTGGGATGATGGAGACTTCCTGGGA

GATGAATCCCTCCAGGAGGAGAAGGACAGCCAGGAGACAGATGGG

CTGCTACCTGGTTCCCGACCCAGCACCCGGATATCTGGCGAGAAG

AGCTTTCGCAGAGCGGGAAGGAGTGTGTTCTCGGCCATGAAACTC

GGCAAAACTCGGTCCCACAAAGAGGAGCCCCAAAGACAAGATGAG

CCAGCAGTGCTGGAGATGGAGGACCTGGACCACCTAGCCATTCAG

CTGGGGGATGGGCTGGACCCTGACTCCGTGTCTCTAGCCTCGGTC

ACCGCTCTCACCAGCAATGTCTCCAACAAACGGTCTAAGCCAGAT

ATTAAGATGGAGCCCAGTGCTGGAAGGCCCATGGATTACCAGGTC

AGCATCACAGTGATTGAGGCTCGGCAGCTGGTGGGCTTGAACATG

GACCCTGTGGTGTGTGTGGAGGTGGGTGATGACAAGAAATACACG

TCAATGAAGGAGTCCACAAACTGCCCTTACTACAACGAGTACTTT

GTCTTCGACTTCCATGTCTCTCCTGATGTCATGTTTGACAAGATC

ATCAAGATCTCGGTTATCCATTCTAAGAACCTGCTTCGGAGCGGC

ACCCTGGTGGGTTCCTTCAAAATGGATGTGGGGACTGTGTATTCC

CAGCCTGAACACCAGTTCCATCACAAATGGGCCATCCTGTCAGAC

CCCGATGACATCTCTGCTGGGTTGAAGGGTTATGTAAAGTGTGAT

GTCGCTGTGGTGGGCAAGGGAGACAACATCAAGACACCCCACAAG

GCCAACGAGACGGATGAGGACGACATTGAAGGGAACTTGCTGCTC

CCCGAGGGCGTGCCCCCCGAACGGCAGTGGGCACGGTTCTATGTG

AAAATTTACCGAGCAGAGGGACTGCCCCGGATGAACACAAGCCTC

ATGGCCAACGTGAAGAAGGCGTTCATCGGTGAGAACAAGGACCTC

GTCGACCCCTATGTGCAAGTCTTCTTTGCTGGACAAAAGGGCAAA

ACATCAGTGCAGAAGAGCAGCTATGAGCCGCTATGGAATGAGCAG
```

-continued

GTCGTCTTCACAGACTTGTTCCCCCCACTCTGCAAACGCATGAAG

GTGCAGATCCGGGACTCTGACAAGGTCAATGATGTGGCCATCGGC

ACCCACTTCATCGACCTGCGCAAGATTTCCAACGATGGAGACAAA

GGCTTCCTGCCTACCCTCGGTCCAGCCTGGGTGAACATGTACGGC

TCCACGCGCAACTACACACTGCTGGACGAGCACCAGGACTTGAAT

GAAGGCCTGGGGAGGGTGTGTCCTTCCGGGCCCGCCTCATGTTG

GGACTAGCTGTGGAGATCCTGGACACCTCCAACCCAGAGCTCACC

AGCTCCACGGAGGTGCAGGTGGAGCAGGCCACGCCTGTCTCGGAG

AGCTGCACAGGGAGAATGGAAGAATTTTTTCTATTTGGAGCCTTC

TTGGAAGCCTCAATGATTGACCGGAAAAATGGGGACAAGCCAATT

ACCTTTGAGGTGACCATAGGAAACTACGGCAATGAAGTCGATGGT

ATGTCCCGGCCCCTGAGGCCTCGGCCCCGGAAAGAGCCTGGGGAT

GAAGAAGAGGTAGACCTGATTCAGAACTCCAGTGACGATGAAGGT

GACGAAGCCGGGGACCTGGCCTCGGTGTCCTCCACCCCACCTATG

CGGCCCCAGATCACGGACAGGAACTATTTCCACCTGCCCTACCTG

GAGCGCAAGCCCTGCATCTATATCAAGAGCTGGTGGCCTGACCAG

AGGCGGCGCCTCTACAATGCCAACATCATGGATCACATTGCTGAC

AAGCTGGAAGAAGGCCTGAATGATGTACAGGAGATGATCAAAACG

GAGAAGTCCTACCCGGAGCGCCGCCTGCGGGGTGTGCTAGAGGAA

CTCAGCTGTGGCTGCCACCGCTTCCTCTCCCTCTCGGACAAGGAC

CAGGGCCGCTCGTCCCGCACCAGGCTGGATCGAGAGCGTCTTAAG

TCCTGTATGAGGGAGTTGGAGAGCATGGGACAGCAGGCCAAGAGC

CTGAGGGCTCAGGTGAAGCGGCACACTGTTCGGGACAAGCTGAGG

TCATGCCAGAACTTTCTGCAGAAGCTACGCTTCCTGGCGGATGAG

3'mOTOF DNA Sequence (SEQ ID NO: 95)

CCCCAGCACAGCATTCCGGATGTGTTCATTTGGATGATGAGCAAC

AACAAACGTATCGCCTATGCCCGCGTGCCTTCCAAAGACCTGCTC

TTCTCCATCGTGGAGGAGGAACTGGGCAAGGACTGCGCCAAAGTC

AAGACCCTCTTCCTGAAGCTGCCAGGGAAGAGGGGCTTCGGCTCG

GCAGGCTGGACAGTACAGGCCAAGCTGGAGCTCTACCTGTGGCTG

GGCCTCAGCAAGCAGCGAAAGGACTTCCTGTGTGGTCTGCCCTGT

GGCTTCGAGGAGGTCAAGGCAGCCCAAGGCCTGGGCCTGCATTCC

TTTCCGCCCATCAGCCTAGTCTACACCAAGAAGCAAGCCTTCCAG

CTCCGAGCACACATGTATCAGGCCCGAAGCCTCTTTGCTGCTGAC

AGCAGTGGGCTCTCTGATCCCTTTGCCCGTGTCTTCTTCATCAAC

CAGAGCCAATGCACTGAGGTTCTAAACGAGACACTGTGTCCCACC

TGGGACCAGATGTCTGGTATTTGACAACCTGGAGCTGTACGGTGAA

GCTCACGAGTTACGAGATGATCCCCCCATCATTGTCATTGAAATC

TACGACCAGGACAGCATGGGCAAAGCCGACTTCATGGGCCGGACC

TTCGCCAAGCCCCTGGTGAAGATGGCAGATGAAGCATACTGCCCA

CCTCGCTTCCCGCCGCAGCTTGAGTACTACCAGATCTACCGAGGC

-continued

AGTGCCACTGCCGGAGACCTACTGGCTGCCTTCGAGCTGCTGCAG

ATTGGGCCATCAGGGAAGGCTGACCTGCCACCCATCAATGGCCCA

GTGGACATGGACAGAGGGCCCATCATGCCTGTGCCCGTGGGAATC

CGGCCAGTGCTCAGCAAGTACCGAGTGGAGGTGCTGTTCTGGGGC

CTGAGGGACCTAAAGAGGGTGAACCTGGCCCAGGTGGACCGACCA

CGGGTGGACATCGAGTGTGCAGGAAAGGGGGTACAATCCTCCCTG

ATTCACAATTATAAGAAGAACCCCAACTTCAACACGCTGGTCAAG

TGGTTGAAGTGGACCTCCCGGAGAATGAGCTCCTGCACCCACCC

TTGAACATCCGAGTGGTAGATTGCCGGGCCTTTGGACGATACACC

CTGGTGGGTTCCCACGCAGTCAGCTCACTGAGGCGCTTCATCTAC

CGACCTCCAGACCGCTCAGCCCCCAACTGGAACACCACAGGGGAG

GTTGTAGTAAGCATGGAGCCTGAGGAGCCAGTTAAGAAGCTGGAG

ACCATGGTGAAACTGGATGCGACTTCTGATGCTGTGGTCAAGGTG

GATGTGGCTGAAGATGAGAAGGAAAGGAAGAAGAAGAAAAAGAAA

GGCCCGTCAGAGGAGCCAGAGGAGGAAGAGCCCGATGAGAGCATG

CTGGATTGGTGGTCCAAGTACTTCGCCTCCATCGACACAATGAAG

GAGCAACTTCGACAACATGAGACCTCTGGAACTGACTTGGAAGAG

AAGGAAGAGATGGAAAGCGCTGAGGGCCTGAAGGGACCAATGAAG

AGCAAGGAGAAGTCCAGAGCTGCAAAGGAGGAGAAAAAGAAGAAA

AACCAGAGCCCTGGCCCTGGCCAGGGATCGGAGGCTCCTGAGAAG

AAGAAAGCCAAGATCGATGAGCTTAAGGTGTACCCCAAGGAGCTG

GAATCGGAGTTTGACAGCTTTGAGGACTGGCTGCACACCTTCAAC

CTGTTGAGGGCAAGACGGGAGATGATGAGGATGGCTCCACAGAG

GAGGAGCGCATAGTAGGCCGATTCAAGGGCTCCCTCTGTGTGTAC

AAAAGTGCCACTCCCAGAAGATGTATCTCGAGAAGCTGGCTATGAT

CCCACCTATGGAATGTTCCAGGGCATCCCAAGCAATGACCCCATC

AATGTGCTGGTCCGAATCTATGTGGTCCGGGCCACAGACCTGCAC

CCGGCCGACATCAATGGCAAAGCTGACCCCTATATTGCCATCAAG

TTAGGCAAGACCGACATCCGAGACAAGGAGAACTACATCTCCAAG

CAGCTCAACCCTGTGTTTGGGAAGTCCTTTGACATTGAGGCCTCC

TTCCCCATGGAGTCCATGTTGACAGTGGCCGTGTACGACTGGGAT

CTGGTGGGCACTGATGACCTCATCGGAGAAACCAAGATTGACCTG

GAAAACCGCTTCTACAGCAAGCATCGCGCCACCTGCGCATCGCA

CAGACCTATTCCATACATGGCTACAATATCTGGAGGGACCCCATG

AAGCCCAGCCAGATCCTGACACGCCTCTGTAAAGAGGGCAAAGTG

GACGGCCCCACTTTGGTCCCCATGGGAGAGTGAGGGTTGCCAAC

CGTGTCTTCACGGGGCCTTCAGAAATAGAGGATGAGAATGGTCAG

AGGAAGCCCACAGATGAGCACGTGGCACTGTCTGCTCTGAGACAC

TGGGAGGACATCCCCGGGTGGGCTGCCGCCTTGTGCCGGAACAC

GTGGAGACCAGGCCGCTGCTCAACCCTGACAAGCCAGGCATTGAG

-continued

```
CAGGGCCGCCTGGAGCTGTGGGTGGACATGTTCCCCATGGACATG

CCAGCCCCTGGGACACCTCTGGATATATCCCCCAGGAAACCCAAG

AAGTACGAGCTGCGGGTCATCGTGTGGAACACAGACGAGGTGGTC

CTGGAAGACGATGATTTCTTCACGGGAGAGAAGTCCAGTGACATT

TTTGTGAGGGGGTGGCTGAAGGGCCAGCAGGAGGACAAACAGGAC

ACAGATGTCCACTATCACTCCCTCACGGGGGAGGGCAACTTCAAC

TGGAGATACCTCTTCCCCTTCGACTACCTAGCGGCCGAAGAGAAG

ATCGTTATGTCCAAAAAGGAGTCTATGTTCTCCTGGGATGAGACG

GAGTACAAGATCCCTGCGCGGCTCACCCTGCAGATCTGGGACGCT

GACCACTTCTCGGCTGACGACTTCCTGGGGGCTATCGAGCTGGAC

CTGAACCGGTTCCCGAGGGGCGCTAAGACAGCCAAGCAGTGCACC

ATGGAGATGGCCACCGGGGAGGTGGACGTACCCCTGGTTTCCATC

TTTAAACAGAAACGTGTCAAAGGCTGGTGGCCCCTCCTGGCCCGC

AATGAGAATGATGAGTTTGAGCTCACAGGCAAAGTGGAGGCGGAG

CTACACCTACTCACGGCAGAGGAGGCAGAGAAGAACCCTGTGGGC

CTGGCTCGCAATGAACCTGATCCCCTAGAAAAACCCAACCGGCCT

GACACGGCATTCGTCTGGTTCCTGAACCCACTCAAATCTATCAAG

TACCTCATCTGCACCCGGTACAAGTGGCTGATCATCAAGATCGTG

CTGGCGCTGCTGGGGCTGCTCATGCTGGCCCTCTTCCTTTACAGC

CTCCCAGGCTACATGGTCAAGAAGCTCCTAGGGGCCTGA
```

Some embodiments of any of the compositions described herein can include a first vector including the coding sequence of SEQ ID NO: 94 (or include a sequence that is at least 80%, at least 82%, at least 84%, at least 86%, at least 88%, at least 90%, at least 92%, at least 94%, at least 96%, at least 98%, or at least 99% identical to SEQ ID NO: 94). Some embodiments of any of the compositions described herein can include a second vector including the coding sequence of SEQ ID NO: 95 (or include a sequence that is at least 80%, at least 82%, at least 84%, at least 86%, at least 88%, at least 90%, at least 92%, at least 94%, at least 96%, at least 98%, or at least 99% identical to SEQ ID NO: 95).

Some embodiments of any of the compositions described herein can include a first vector with a 5' OTOF coding region that comprises exons 1 to (and through) 21 of OTOF cDNA. Some embodiments of any of the compositions described herein can include a first vector that comprises the nucleotide sequence of SEQ ID NO: 101 (or a sequence that is at least 70%, at least 75%, at least 80%, at least 82%, at least 84%, at least 86%, at least 88%, at least 90%, at least 92%, at least 94%, at least 96%, at least 98%, or at least 99% identical to the nucleotide sequence of SEQ ID NO: 101). Some embodiments of any of the compositions described herein can include a first vector that comprises a nucleotide sequence that is at least 70%, at least 75%, at least 80%, at least 82%, at least 84%, at least 86%, at least 88%, at least 90%, at least 92%, at least 94%, at least 96%, at least 98%, or at least 99% identical to the nucleotide sequence of SEQ ID NO: 101, and encodes the same amino acid sequence as SEQ ID NO: 101. In some embodiments, a composition of the present disclosure includes a first vector that comprises a codon optimized version of SEQ ID NO: 101, i.e., a nucleotide sequence that encodes the same amino acid sequence as SEQ ID NO: 101 but with codons that have been optimized for expression in a particular cell type, e.g., a mammalian cell, e.g., a human cell. In some embodiments the first vector does not include any other portion of an OTOF gene. In some embodiments the first vector does not include any other portion of OTOF cDNA.

Some embodiments of any of the compositions described herein can include a second vector with a 3' OTOF coding region that comprises exons 22 to (and through) exon 48 of OTOF cDNA. Some embodiments of any of the compositions described herein can include a second vector that comprises the nucleotide sequence of SEQ ID NO: 108 (or a sequence that is at least 70%, at least 75%, at least 80%, at least 82%, at least 84%, at least 86%, at least 88%, at least 90%, at least 92%, at least 94%, at least 96%, at least 98%, or at least 99% identical to the nucleotide sequence of SEQ ID NO: 108). Some embodiments of any of the compositions described herein can include a second vector that comprises a nucleotide sequence that is at least 70%, at least 75%, at least 80%, at least 82%, at least 84%, at least 86%, at least 88%, at least 90%, at least 92%, at least 94%, at least 96%, at least 98%, or at least 99% identical to the nucleotide sequence of SEQ ID NO: 108, and encodes the same amino acid sequence as SEQ ID NO: 108. In some embodiments, a composition of the present disclosure includes a second vector that comprises a codon optimized version of SEQ ID NO: 108, i.e., a nucleotide sequence that encodes the same amino acid sequence as SEQ ID NO: 108 but with codons that have been optimized for expression in a particular cell type, e.g., a mammalian cell, e.g., a human cell. In some embodiments the second vector does not include any other portion of an OTOF gene. In some embodiments the second vector does not include any other portion of OTOF cDNA.

Vectors

Provided herein are compositions of matter and methods of use for the treatment of a disease such as nonsyndromic hearing loss, using nucleic acid therapeutics such as auditory polypeptide messenger RNAs. Preferably, the auditory polypeptide nucleic acids are present in viral vectors, such as adeno-associated viral vectors, adenoviral vectors, lentiviral vectors, and retroviral vectors.

The foregoing methods for packaging recombinant vectors in desired AAV capsids to produce the rAAVs (or rAAV particles) of the disclosure are not meant to be limiting and other suitable methods will be apparent to the skilled artisan.

Expression control sequences include appropriate transcription initiation, termination, promoter and enhancer sequences; efficient RNA processing signals such as splicing and polyadenylation (polyA) signals; sequences that stabilize cytoplasmic mRNA; sequences that enhance translation efficiency (i.e., Kozak consensus sequence); sequences that enhance protein stability; and when desired, sequences that enhance secretion of the encoded product. A great number of expression control sequences, including promoters which are native, constitutive, inducible and/or tissue-specific, are known in the art and may be utilized.

As used herein, a nucleic acid sequence (e.g., coding sequence) and regulatory sequences are said to be "operably" linked when they are covalently linked in such a way as to place the expression or transcription of the nucleic acid sequence under the influence or control of the regulatory sequences. If it is desired that the nucleic acid sequences be translated into a functional protein, two DNA sequences are said to be operably linked if induction of a promoter in the 5' regulatory sequences results in the transcription of the coding sequence and if the nature of the linkage between the two DNA sequences does not (1) result in the introduction of a frame-shift mutation, (2) interfere with the ability of the promoter region to direct the transcription of the coding sequences, or (3) interfere with the ability of the corresponding RNA transcript to be translated into a protein. Thus, a promoter region would be operably linked to a nucleic acid sequence if the promoter region were capable of effecting transcription of that DNA sequence such that the resulting transcript might be translated into the desired protein or polypeptide. Similarly two or more coding regions are operably linked when they are linked in such a way that their transcription from a common promoter results in the expression of two or more proteins having been translated in frame. In some embodiments, operably linked coding sequences yield a fusion protein. In some embodiments, operably linked coding sequences yield a functional RNA (e.g., shRNA, miRNA, miRNA inhibitor).

For nucleic acids encoding proteins, a polyadenylation sequence generally is inserted following the transgene sequences and before the 3' AAV ITR sequence. A rAAV construct useful in the present disclosure may also contain an intron, desirably located between the promoter/enhancer sequence and the transgene. One possible intron sequence is derived from SV-40, and is referred to as the SV-40 T intron sequence. One possible intron sequence has the nucleotide sequence of SEQ ID NO: 100. Another vector element that may be used is an internal ribosome entry site (IRES). An IRES sequence is used to produce more than one polypeptide from a single gene transcript. An IRES sequence would be used to produce a protein that contains more than one polypeptide chain. Selection of these and other common vector elements is conventional, and many such sequences are available [see, e.g., Sambrook et al. "Molecular Cloning. A Laboratory Manual", 2d ed., Cold Spring Harbor Laboratory, New York (1989), and references cited therein at, for example, pages 3.18 3.26 and 16.17 16.27 and Ausubel et al., Current Protocols in Molecular Biology, John Wiley & Sons, New York, 1989]. In some embodiments, a Foot and Mouth Disease Virus 2A sequence is included in polyprotein; this is a small peptide (approximately 18 amino acids in length) that has been shown to mediate the cleavage of polyproteins (Ryan, M D et al., EMBO, 1994; 4: 928-933; Mattion, N M et al., J Virology, November 1996; p. 8124-8127; Furler, S et al., Gene Therapy, 2001; 8: 864-873; and Halpin, C et al., The Plant Journal, 1999; 4: 453-459). The cleavage activity of the 2A sequence has previously been demonstrated in artificial systems including plasmids and gene therapy vectors (AAV and retroviruses) (Ryan, M D et al., EMBO, 1994; 4: 928-933; Mattion, N M et al., J Virology, November 1996; p. 8124-8127; Furler, S et al., Gene Therapy, 2001; 8: 864-873; and Halpin, C et al., The Plant Journal, 1999; 4: 453-459; de Felipe, P et al., Gene Therapy, 1999; 6: 198-208; de Felipe, P et al., Human Gene Therapy, 2000; 11: 1921-1931; and Klump, H et al., Gene Therapy, 2001; 8: 811-817).

The precise nature of the regulatory sequences needed for gene expression in host cells may vary between species, tissues or cell types, but shall in general include, as necessary, 5' non-transcribed and 5' non-translated sequences involved with the initiation of transcription and translation respectively, such as a TATA box, capping sequence, CAAT sequence, enhancer elements, and the like. Especially, such 5' non-transcribed regulatory sequences will include a promoter region that includes a promoter sequence for transcriptional control of the operably joined gene. Regulatory sequences may also include enhancer sequences or upstream activator sequences as desired. The vectors of the disclosure may optionally include 5' leader or signal sequences. The choice and design of an appropriate vector is within the ability and discretion of one of ordinary skill in the art.

Examples of constitutive promoters include, without limitation, the retroviral Rous sarcoma virus (RSV) LTR promoter (optionally with the RSV enhancer), the cytomegalovirus (CMV) promoter (optionally with the CMV enhancer) [see, e.g., Boshart et al. (1985) Cell, 41:521-530], the SV40 promoter, the dihydrofolate reductase promoter, the .beta.-actin promoter, the phosphoglycerol kinase (PGK) promoter (Gilham et al., J. Gene Med. 12(2):129-136, 2010), and the EF1.alpha. promoter [Invitrogen].

Inducible promoters allow regulation of gene expression and can be regulated by exogenously supplied compounds, environmental factors such as temperature, or the presence of a specific physiological state, e.g., acute phase, a particular differentiation state of the cell, or in replicating cells only. Inducible promoters and inducible systems are available from a variety of commercial sources, including, without limitation, Invitrogen, Clontech and Ariad. Many other systems have been described and can be readily selected by one of skill in the art. Examples of inducible promoters regulated by exogenously supplied promoters include the zinc-inducible sheep metallothionine (MT) promoter, the dexamethasone (Dex)-inducible mouse mammary tumor virus (MMTV) promoter, the T7 polymerase promoter system (WO 98/10088); the ecdysone insect promoter (No et al. (1996) Proc. Natl. Acad. Sci. USA, 93:3346-3351), the tetracycline-repressible system (Gossen et al. Proc. Natl. Acad. Sci. USA, 89:5547-5551 (1992)), the tetracycline-inducible system (Gossen et al. Science, 268:1766-1769 (1995), see also Harvey et al. Curr. Opin. Chem. Biol., 2:512-518 (1998)), the RU486-inducible system (Wang et al. Nat. Biotech., 15:239-243 (1997) and Wang et al. Gene Ther., 4:432-441 (1997)) and the rapamycin-inducible system (Magari et al. J. Clin. Invest., 100:2865-2872 (1997)). Still other types of inducible promoters which may be useful in this context are those which are regulated by a specific physiological state, e.g., temperature, acute phase, a particular differentiation state of the cell, or in replicating cells only.

In another embodiment, the native promoter for the transgene will be used. The native promoter may be preferred when it is desired that expression of the transgene should mimic the native expression. The native promoter may be used when expression of the transgene must be regulated temporally or developmentally, or in a tissue-specific manner, or in response to specific transcriptional stimuli. In a further embodiment, other native expression control elements, such as enhancer elements, polyadenylation sites or Kozak consensus sequences may also be used to mimic the native expression.

In some embodiments, the regulatory sequences impart tissue-specific gene expression capabilities. In some cases, the tissue-specific regulatory sequences bind tissue-specific transcription factors that induce transcription in a tissue specific manner. Such tissue-specific regulatory sequences (e.g., promoters, enhancers, etc.) are well known in the art. Exemplary tissue-specific regulatory sequences include, but are not limited to the following tissue specific promoters: a liver-specific thyroxin binding globulin (TBG) promoter, an insulin promoter, a glucagon promoter, a somatostatin promoter, a pancreatic polypeptide (PPY) promoter, a synapsin-1 (Syn) promoter (Kugler et al., Virology 311:89-95, 2003; Hioki et al., Gene Ther. 14:872-882, 2007; Kuroda et al., J. Gene Med 10:1163-1175, 2008), a creatine kinase (MCK) promoter (Wang et al., Gene Ther. 15:1489-1499, 2008; Talbot et al., Mol. Ther. 18:601-608, 2010; Katwal et al., Gene Ther. 20(9):930-938, 2013), a mammalian desmin (DES) promoter (Talbot et al., *Mol. Ther.* 18:601-608, 2010), a C5-12 promoter (Wang et al., *Gene Ther.* 15:1489-1499, 2008), an α-myosin heavy chain (a-MHC) promoter, a PDGF promoter (Patterna, *Gene Ther.* 7(15):1304-1311, 2000; Hioki et al., *Gene Ther.* 14:872-882, 2007), MecP2 promoter (Rastegar et al., *PLoS One* 4:e6810, 2009; Gray et al., *Human Gene Ther.* 22:1143-1153, 2011), CaMKII promoter (Hioki et al., *Gene Ther.* 14:872-882, 2007; Kuroda et al., *J. Gene Med* 10:1163-1175, 2008), mGluR2 promoter (Brene et al., *Eur. J. Eurosci.* 12:1525-1533, 2000; Kuroda et al., *J. Gene Med* 10:1163-1175, 2008), NFL promoter (Xu et al., *Human Gene Ther.* 12(5):563-573, 2001; Xu et al., *Gene Ther.* 8:1323-1332, 2001), NFH promoter (Xu et al., *Human Gene Ther.* 12(5):563-573, 2001; Xu et al., *Gene Ther.* 8:1323-1332, 2001), nJ2 promoter (Xu et al., *Human Gene Ther.* 12(5):563-573, 2001; Xu et al., *Gene Ther.* 8:1323-1332, 2001), PPE promoter (Xu et al., *Human Gene Ther.* 12(5):563-573, 2001; Xu et al., *Gene Ther.* 8:1323-1332, 2001), Enk promoter (Xu et al., *Human Gene Ther.* 12(5):563-573, 2001; Xu et al., *Gene Ther.* 8:1323-1332, 2001), EAAT2 promoter (Su et al., *Proc. Natl. Acad Sci. U.S.A.* 100:1955-1960, 2003; Kuroda et al., *J. Gene Med* 10:1163-1175, 2008), GFAP promoter (Brenner et al., *J. Neurosci.* 14:1030-1037, 1994; Xu et al., *Human Gene Ther.* 12(5):563-573, 2001; Xu et al., *Gene Ther.* 8:1323-1332, 2001; Lee et al., *Glia* 56:481-493, 2008; Dirren et al., *Human Gene Ther.* 25:109-120, 2014), MBP promoter (Chen et al., *Gene Ther.* 5(1):50-58, 1998), or a cardiac Troponin T (cTnT) promoter. Other exemplary promoters include Beta-actin promoter, hepatitis B virus core promoter, Sandig et al., Gene Ther., 3:1002-9 (1996); alpha-fetoprotein (AFP) promoter, Arbuthnot et al., Hum. Gene Ther., 7:1503-14 (1996)), bone osteocalcin promoter (Stein et al., Mol. Biol. Rep., 24:185-96 (1997)); bone sialoprotein promoter (Chen et al., J. Bone Miner. Res., 11:654-64 (1996)), CD2 promoter (Hansal et al., J. Immunol., 161:1063-8 (1998); immunoglobulin heavy chain promoter; T cell receptor .alpha.-chain promoter, neuronal such as neuron-specific enolase (NSE) promoter (Andersen et al., Cell. Mol. Neurobiol., 13:503-15 (1993); Xu et al., *Human Gene Ther.* 12(5):563-573, 2001; Xu et al., *Gene Ther.* 8:1323-1332, 2001), neurofilament light-chain gene promoter (Piccioli et al., Proc. Natl. Acad. Sci. USA, 88:5611-5 (1991)), and the neuron-specific vgf gene promoter (Piccioli et al., Neuron, 15:373-84 (1995)), among others which will be apparent to the skilled artisan.

In some embodiments, one or more bindings sites for one or more miRNAs are incorporated in a transgene of a rAAV vector, to inhibit the expression of the transgene in one or more tissues of an subject harboring the transgene. The skilled artisan will appreciate that binding sites may be selected to control the expression of a transgene in a tissue specific manner. For example, binding sites for the liver-specific miR-122 may be incorporated into a transgene to inhibit expression of that transgene in the liver. The target sites in the mRNA may be in the 5' UTR, the 3' UTR or in the coding region. Typically, the target site is in the 3' UTR of the mRNA. Furthermore, the transgene may be designed such that multiple miRNAs regulate the mRNA by recognizing the same or multiple sites. The presence of multiple miRNA binding sites may result in the cooperative action of multiple RISCs and provide highly efficient inhibition of expression. The target site sequence may comprise a total of 5-100, 10-60, or more nucleotides. The target site sequence may comprise at least 5 nucleotides of the sequence of a target gene binding site.

Auditory Polypeptides and Auditory Polypeptide Transgene Coding Sequences

The composition of the auditory polypeptide transgene sequence of the rAAV vector will depend upon the use to which the resulting vector will be generated. Thus, the disclosure embraces the delivery of rAAV vectors encoding one or more auditory polypeptides, peptides, or proteins, which are useful for the treatment or prevention of disease states associated with hearing loss in a mammalian subject. Exemplary therapeutic proteins include one or more polypeptides selected from the group consisting of otoferlin, $Ca_v1.3$, a scaffold protein selected from bassoon, piccolo, ribeye, and harmonin, Vglut3, synaptotagmin, a vesicle tethering/docking protein, a vesicle priming protein, a vesicle fusion protein, GluA2/3, or GluA4.

Optionally included in the AAV compositions are polypeptide reporter proteins. Reporter sequences that may be provided in a transgene include, without limitation, DNA sequences encoding .beta.-lactamase, .beta.-galactosidase (LacZ), alkaline phosphatase, thymidine kinase, green fluorescent protein (GFP), chloramphenicol acetyltransferase (CAT), luciferase, and others well known in the art. When associated with regulatory elements which drive their expression, the reporter sequences provide signals detectable by conventional means, including enzymatic, radiographic, colorimetric, fluorescence or other spectrographic assays, fluorescent activating cell sorting assays, and immunological assays, including enzyme linked immunosorbent assay (ELISA), radioimmunoassay (RIA) and immunohistochemistry. For example, where the marker sequence is the LacZ gene, the presence of the vector carrying the signal is detected by assays for J-galactosidase activity. Where the transgene is green fluorescent protein or luciferase, the vector carrying the signal may be measured visually by color or light production in a luminometer. Such reporters can, for example, be useful in verifying the tissue-specific targeting capabilities and tissue specific promoter regulatory activity of an rAAV.

In another example, the transgene encodes a protein or functional RNA that is intended to be used to create an animal model of disease. Appropriate transgene coding sequences will be apparent to the skilled artisan.

The rAAV vectors may comprise a gene or a portion of a gene encoding an auditory polypeptide, to be transferred to a subject to treat a disease associated with reduced expression, lack of expression or dysfunction of the auditory polypeptide gene or another gene in the functional pathway of an auditory polypeptide.

In a first aspect, provided are therapeutic compositions including a plurality of adeno-associated viral (AAV) vectors, wherein the plurality of AAV vectors are capable of constituting an auditory polypeptide messenger RNA in a target cell of a human subject to whom the therapeutic composition is administered. Preferably, the plurality of AAV vectors are capable of constituting a full-length auditory polypeptide messenger RNA in a target cell of a human subject to whom the therapeutic composition is administered. The plurality of AAV vectors include a first AAV vector and a second AAV vector, wherein the first and second AAV vectors independently contain packaging capacity of less than about 6 kb. The auditory polypeptide messenger RNA encodes an auditory polypeptide selected from the group consisting of otoferlin and an ortholog or homolog thereof, for example, as provided herein. The AAV vectors contain at least one promoter sequence selected from a CBA, a CMV, or a CB7 promoter, or one or more Cochlea-specific promoters. In some embodiments, an AAV vector can include a CMV enhancer and promoter sequence, e.g., SEQ ID NO: 70. In some embodiments, an AAV vector can include a CMV enhancer and a chicken β-actin (CBA) promoter, e.g., SEQ ID NO: 61. In some embodiments, an AAV vector can include a CMVd promoter sequence, e.g., SEQ ID NO: 86. In some embodiments, an AAV vector can include a promoter that comprises a CMV enhancer and a CBA promoter, e.g., the nucleotide sequences of SEQ ID NO: 98 and 99. In some embodiments, the nucleotide sequence of SEQ ID NO: 98 precedes the nucleotide sequence of SEQ ID NO: 99 and is optionally followed by a chimeric intron, e.g., the nucleotide sequence of SEQ ID NO: 100.

The compositions provided herein include at least two (e.g., two, three, four, five, or six) nucleic acid vectors, where: each of the at least two different vectors includes a coding sequence that encodes a different portion of an otoferlin protein, each of the encoded portions being at least 30 amino acids (e.g., between about 30 amino acids to about 1950 amino acids, about 30 amino acids to about 1900 amino acids, about 30 amino acids to about 1850 amino acids, about 30 amino acids to about 1800 amino acids, about 30 amino acids to about 1750 amino acids, about 30 amino acids to about 1700 amino acids, about 30 amino acids to about 1650 amino acids, about 30 amino acids to about 1600 amino acids, about 30 amino acids to about 1550 amino acids, about 30 amino acids to about 1500 amino acids, about 30 amino acids to about 1450 amino acids, about 30 amino acids to about 1400 amino acids, about 30 amino acids to about 1350 amino acids, about 30 amino acids to about 1300 amino acids, about 30 amino acids to about 1250 amino acids, about 30 amino acids to about 1200 amino acids, about 30 amino acids to about 1150 amino acids, about 30 amino acids to about 1100 amino acids, about 30 amino acids to about 1050 amino acids, about 30 amino acids to about 1000 amino acids, about 30 amino acids to about 950 amino acids, about 30 amino acids to about 900 amino acids, about 30 amino acids to about 850 amino acids, about 30 amino acids to about 800 amino acids, about 30 amino acids to about 750 amino acids, about 30 amino acids to about 700 amino acids, about 30 amino acids to about 650 amino acids, about 30 amino acids to about 600 amino acids, about 30 amino acids to about 550 amino acids, about 30 amino acids to about 500 amino acids, about 30 amino acids to about 450 amino acids, about 30 amino acids to about 400 amino acids, about 30 amino acids to about 350 amino acids, about 30 amino acids to about 300 amino acids, about 30 amino acids to about 250 amino acids, about 30 amino acids to about 200 amino acids, about 30 amino acids to about 150 amino acids, about 30 amino acids to about 100 amino acids, about 30 amino acids to about 50 amino acids, about 50 amino acids to about 1950 amino acids, about 50 amino acids to about 1900 amino acids, about 50 amino acids to about 1850 amino acids, about 50 amino acids to about 1800 amino acids, about 50 amino acids to about 1750 amino acids, about 50 amino acids to about 1700 amino acids, about 50 amino acids to about 1650 amino acids, about 50 amino acids to about 1600 amino acids, about 50 amino acids to about 1550 amino acids, about 50 amino acids to about 1500 amino acids, about 50 amino acids to about 1450 amino acids, about 50 amino acids to about 1400 amino acids, about 50 amino acids to about 1350 amino acids, about 50 amino acids to about 1300 amino acids, about 50 amino acids to about 1250 amino acids, about 50 amino acids to about 1200 amino acids, about 50 amino acids to about 1150 amino acids, about 50 amino acids to about 1100 amino acids, about 50 amino acids to about 1050 amino acids, about 50 amino acids to about 1000 amino acids, about 50 amino acids to about 950 amino acids, about 50 amino acids to about 900 amino acids, about 50 amino acids to about 850 amino acids, about 50 amino acids to about 800 amino acids, about 50 amino acids to about 750 amino acids, about 50 amino acids to about 700 amino acids, about 50 amino acids to about 650 amino acids, about 50 amino acids to about 600 amino acids, about 50 amino acids to about 550 amino acids, about 50 amino acids to about 500 amino acids, about 50 amino acids to about 450 amino acids, about 50 amino acids to about 400 amino acids, about 50 amino acids to about 350 amino acids, about 50 amino acids to about 300 amino acids, about 50 amino acids to about 250 amino acids, about 50 amino acids to about 200 amino acids, about 50 amino acids to about 150 amino acids, about 50 amino acids to about 100 amino acids, about 100 amino acids to about 1950 amino acids, about 100 amino acids to about 1900 amino acids, about 100 amino acids to about 1850 amino acids, about 100 amino acids to about 1800 amino acids, about 100 amino acids to about 1750 amino acids, about 100 amino acids to about 1700 amino acids, about 100 amino acids to about 1650 amino acids, about 100 amino acids to about 1600 amino acids, about 100 amino acids to about 1550 amino acids, about 100 amino acids to about 1500 amino acids, about 100 amino acids to about 1450 amino acids, about 100 amino acids to about 1400 amino acids, about 100 amino acids to about 1350 amino acids, about 100 amino acids to about 1300 amino acids, about 100 amino acids to about 1250 amino acids, about 100 amino acids to about 1200 amino acids, about 100 amino acids to about 1150 amino acids, about 100 amino acids to about 1100 amino acids, about 100 amino acids to about 1050 amino acids, about 100 amino acids to about 1000 amino acids, about 100 amino acids to about 950 amino acids, about 100 amino acids to about 900 amino acids, about 100 amino acids to about 850 amino acids, about 100 amino acids to about 800 amino acids, about 100 amino acids to about 750 amino acids, about 100 amino acids to about 700 amino acids, about 100 amino acids to about 650 amino acids, about 100 amino acids to about 600 amino acids, about 100 amino acids to about 550 amino acids, about 100 amino acids to about 500 amino acids, about 100 amino acids to about 450 amino acids, about 100 amino acids to about 400 amino acids, about 100 amino acids to about 350 amino acids, about 100 amino acids to about 300 amino acids, about 100 amino acids to about 250 amino acids, about 100 amino acids to about 200 amino acids, about 100 amino acids to about 150 amino acids, about 150 amino acids to about 1950 amino acids, about 150 amino acids to about 1900 amino acids, about 150 amino acids to about 1850 amino acids, about 150 amino acids to about 1800 amino acids, about 150 amino acids to about 1750 amino acids, about 150 amino acids to about 1700 amino acids, about 150 amino acids to about 1650 amino acids, about 150 amino acids to about 1600 amino acids, about 150 amino acids to about 1550 amino acids, about 150 amino acids to about 1500 amino acids, about 150 amino acids to about 1450 amino acids, about 150 amino acids to about 1400 amino acids, about 150 amino acids to about 1350 amino acids, about 150 amino acids to about 1300 amino acids, about 150 amino acids to about 1250 amino acids, about 150 amino acids to about 1200 amino acids, about 150 amino acids to about 1150 amino acids, about 150 amino acids to about 1100 amino acids, about 150 amino acids to about 1050 amino acids, about 150 amino acids to about 1000 amino acids, about 150 amino acids to about 950 amino acids, about 150 amino acids to about 900 amino acids, about 150 amino acids to about 850 amino acids, about 150 amino acids to about 800 amino acids, about 150 amino acids to about 750 amino acids, about 150 amino acids to about 700 amino acids, about 150 amino acids to about 650 amino acids, about 150 amino acids to about 600 amino acids, about 150 amino acids to about 550 amino acids, about 150 amino acids to about 500 amino acids, about 150 amino acids to about 450 amino acids, about 150 amino acids to about 400 amino acids, about 150 amino acids to about 350 amino acids, about 150 amino acids to about 300 amino acids, about 150 amino acids to about 250 amino acids, about 150 amino acids to about 200 amino acids, about 200 amino acids to about 1950 amino acids, about 200 amino acids to about 1900 amino acids, about 200 amino acids to about 1850 amino acids, about 200 amino acids to about 1800 amino acids, about 200 amino acids to about 1750 amino acids, about 200 amino acids to about 1700 amino acids, about 200 amino acids to about 1650 amino acids, about 200 amino acids to about 1600 amino acids, about 200 amino acids to about 1550 amino acids, about 200 amino acids to about 1500 amino acids, about 200 amino acids to about 1450 amino acids, about 200 amino acids to about 1400 amino acids, about 200 amino acids to about 1350 amino acids, about 200 amino acids to about 1300 amino acids, about 200 amino acids to about 1250 amino acids, about 200 amino acids to about 1200 amino acids, about 200 amino acids to about 1150 amino acids, about 200 amino acids to about 1100 amino acids, about 200 amino acids to about 1050 amino acids, about 200 amino acids to about 1000 amino acids, about 200 amino acids to about 950 amino acids, about 200 amino acids to about 900 amino acids, about 200 amino acids to about 850 amino acids, about 200 amino acids to about 800 amino acids, about 200 amino acids to about 750 amino acids, about 200 amino acids to about 700 amino acids, about 200 amino acids to about 650 amino acids, about 200 amino acids to about 600 amino acids, about 200 amino acids to about 550 amino acids, about 200 amino acids to about 500 amino acids, about 200 amino acids to about 450 amino acids, about 200 amino acids to about 400 amino acids, about 200 amino acids to about 350 amino acids, about 200 amino acids to about 300 amino acids, about 200 amino acids to about 250 amino acids, about 250 amino acids to about 1950 amino acids, about 250 amino acids to about 1900 amino acids, about 250 amino acids to about 1850 amino acids, about 250 amino acids to about 1800 amino acids, about 250 amino acids to about 1750 amino acids, about 250 amino acids to about 1700 amino acids, about 250 amino acids to about 1650 amino acids, about 250 amino acids to about 1600 amino acids, about 250 amino acids to about 1550 amino acids, about 250 amino acids to about 1500 amino acids, about 250 amino acids to about 1450 amino acids, about 250 amino acids to about 1400 amino acids, about 250 amino acids to about 1350 amino acids, about 250 amino acids to about 1300 amino acids, about 250 amino acids to about 1250 amino acids, about 250 amino acids to about 1200 amino acids, about 250 amino acids to about 1150 amino acids, about 250 amino acids to about 1100 amino acids, about 250 amino acids to about 1050 amino acids, about 250 amino acids to about 1000 amino acids, about 250 amino acids to about 950 amino acids, about 250 amino acids to about 900 amino acids, about 250 amino acids to about 850 amino acids, about 250 amino acids to about 800 amino acids, about 250 amino acids to about 750 amino acids, about 250 amino acids to about 700 amino acids, about 250 amino acids to about 650 amino acids, about 250 amino acids to about 600 amino acids, about 250 amino acids to about 550 amino acids, about 250 amino acids to about 500 amino acids, about 250 amino acids to about 450 amino acids, about 250 amino acids to about 400 amino acids, about 250 amino acids to about 350 amino acids, about 250 amino acids to about 300 amino acids, about 300 amino acids to about 1950 amino acids, about 300 amino acids to about 1900 amino acids, about 300 amino acids to about 1850 amino acids, about 300 amino acids to about 1800 amino acids, about 300 amino acids to about 1750 amino acids, about 300 amino acids to about 1700 amino acids, about 300 amino acids to about 1650 amino acids, about 300 amino acids to about 1600 amino acids, about 300 amino acids to about 1550 amino acids, about 300 amino acids to about 1500 amino acids, about 300 amino acids to about 1450 amino acids, about 300 amino acids to about 1400 amino acids, about 300 amino acids to about 1350 amino acids, about 300 amino acids to about 1300 amino acids, about 300 amino acids to about 1250 amino acids, about 300 amino acids to about 1200 amino acids, about 300 amino acids to about 1150 amino acids, about 300 amino acids to about 1100 amino acids, about 300 amino acids to about 1050 amino acids, about 300 amino acids to about 1000 amino acids, about 300 amino acids to about 950 amino acids, about 300 amino acids to about 900 amino acids, about 300 amino acids to about 850 amino acids, about 300 amino acids to about 800 amino acids, about 300 amino acids to about 750 amino acids, about 300 amino acids to about 700 amino acids, about 300 amino acids to about 650 amino acids, about 300 amino acids to about 600 amino acids, about 300 amino acids to about 550 amino acids, about 300 amino acids to about 500 amino acids, about 300 amino acids to about 450 amino acids, about 300 amino acids to about 400 amino acids, about 300 amino acids to about 350 amino acids, about 350 amino acids to about 1950 amino acids, about 350 amino acids to about 1900 amino acids, about 350 amino acids to about 1850 amino acids, about 350 amino acids to about 1800 amino acids, about 350 amino acids to about 1750 amino acids, about 350 amino acids to about 1700 amino acids, about 350 amino acids to about 1650 amino acids, about 350 amino acids to about 1600 amino acids, about 350 amino acids to about 1550 amino acids, about 350 amino acids to about 1500 amino acids, about 350 amino acids to about 1450 amino acids, about 350 amino acids to about 1400 amino acids, about 350 amino acids to about 1350 amino acids, about 350 amino acids to about 1300 amino acids, about 350 amino acids to about 1250 amino acids, about 350 amino acids to about 1200 amino acids, about 350 amino acids to about 1150 amino acids, about 350 amino acids to about 1100 amino acids, about 350 amino acids to about 1050 amino acids, about 350 amino acids to about 1000 amino acids, about 350 amino acids to about 950 amino acids, about 350 amino acids to about 900 amino acids, about 350 amino acids to about 850 amino acids, about 350 amino acids to about 800 amino acids, about 350 amino acids to about 750 amino acids, about 350 amino acids to about 700 amino acids, about 350 amino acids to about 650 amino acids, about 350 amino acids to about 600 amino acids, about 350 amino acids to about 550 amino acids, about 350 amino acids to about 500 amino acids, about 350 amino acids to about 450 amino acids, about 350 amino acids to about 400 amino acids, about 400 amino acids to about 1950 amino acids, about 400 amino acids to about 1900 amino acids, about 400 amino acids to about 1850 amino acids, about 400 amino acids to about 1800 amino acids, about 400 amino acids to about 1750 amino acids, about 400 amino acids to about 1700 amino acids, about 400 amino acids to about 1650 amino acids, about 400 amino acids to about 1600 amino acids, about 400 amino acids to about 1550 amino acids, about 400 amino acids to about 1500 amino acids, about 400 amino acids to about 1450 amino acids, about 400 amino acids to about 1400 amino acids, about 400 amino acids to about 1350 amino acids, about 400 amino acids to about 1300 amino acids, about 400 amino acids to about 1250 amino acids, about 400 amino acids to about 1200 amino acids, about 400 amino acids to about 1150 amino acids, about 400 amino acids to about 1100 amino acids, about 400 amino acids to about 1050 amino acids, about 400 amino acids to about 1000 amino acids, about 400 amino acids to about 950 amino acids, about 400 amino acids to about 900 amino acids, about 400 amino acids to about 850 amino acids, about 400 amino acids to about 800 amino acids, about 400 amino acids to about 750 amino acids, about 400 amino acids to about 700 amino acids, about 400 amino acids to about 650 amino acids, about 400 amino acids to about 600 amino acids, about 400 amino acids to about 550 amino acids, about 400 amino acids to about 500 amino acids, about 400 amino acids to about 450 amino acids, about 450 amino acids to about 1950 amino acids, about 450 amino acids to about 1900 amino acids, about 450 amino acids to about 1850 amino acids, about 450 amino acids to about 1800 amino acids, about 450 amino acids to about 1750 amino acids, about 450 amino acids to about 1700 amino acids, about 450 amino acids to about 1650 amino acids, about 450 amino acids to about 1600 amino acids, about 450 amino acids to about 1550 amino acids, about 450 amino acids to about 1500 amino acids, about 450 amino acids to about 1450 amino acids, about 450 amino acids to about 1400 amino acids, about 450 amino acids to about 1350 amino acids, about 450 amino acids to about 1300 amino acids, about 450 amino acids to about 1250 amino acids, about 450 amino acids to about 1200 amino acids, about 450 amino acids to about 1150 amino acids, about 450 amino acids to about 1100 amino acids, about 450 amino acids to about 1050 amino acids, about 450 amino acids to about 1000 amino acids, about 450 amino acids to about 950 amino acids, about 450 amino acids to about 900 amino acids, about 450 amino acids to about 850 amino acids, about 450 amino acids to about 800 amino acids, about 450 amino acids to about 750 amino acids, about 450 amino acids to about 700 amino acids, about 450 amino acids to about 650 amino acids, about 450 amino acids to about 600 amino acids, about 450 amino acids to about 550 amino acids, about 450 amino acids to about 500 amino acids, about 500 amino acids to about 1950 amino acids, about 500 amino acids to about 1900 amino acids, about 500 amino acids to about 1850 amino acids, about 500 amino acids to about 1800 amino acids, about 500 amino acids to about 1750 amino acids, about 500 amino acids to about 1700 amino acids, about 500 amino acids to about 1650 amino acids, about 500 amino acids to about 1600 amino acids, about 500 amino acids to about 1550 amino acids, about 500 amino acids to about 1500 amino acids, about 500 amino acids to about 1450 amino acids, about 500 amino acids to about 1400 amino acids, about 500 amino acids to about 1350 amino acids, about 500 amino acids to about 1300 amino acids, about 500 amino acids to about 1250 amino acids, about 500 amino acids to about 1200 amino acids, about 500 amino acids to about 1150 amino acids, about 500 amino acids to about 1100 amino acids, about 500 amino acids to about 1050 amino acids, about 500 amino acids to about 1000 amino acids, about 500 amino acids to about 950 amino acids, about 500 amino acids to about 900 amino acids, about 500 amino acids to about 850 amino acids, about 500 amino acids to about 800 amino acids, about 500 amino acids to about 750 amino acids, about 500 amino acids to about 700 amino acids, about 500 amino acids to about 650 amino acids, about 500 amino acids to about 600 amino acids, about 500 amino acids to about 550 amino acids, about 550 amino acids to about 1950 amino acids, about 550 amino acids to about 1900 amino acids, about 550 amino acids to about 1850 amino acids, about 550 amino acids to about 1800 amino acids, about 550 amino acids to about 1750 amino acids, about 550 amino acids to about 1700 amino acids, about 550 amino acids to about 1650 amino acids, about 550 amino acids to about 1600 amino acids, about 550 amino acids to about 1550 amino acids, about 550 amino acids to about 1500 amino acids, about 550 amino acids to about 1450 amino acids, about 550 amino acids to about 1400 amino acids, about 550 amino acids to about 1350 amino acids, about 550 amino acids to about 1300 amino acids, about 550 amino acids to about 1250 amino acids, about 550 amino acids to about 1200 amino acids, about 550 amino acids to about 1150 amino acids, about 550 amino acids to about 1100 amino acids, about 550 amino acids to about 1050 amino acids, about 550 amino acids to about 1000 amino acids, about 550 amino acids to about 950 amino acids, about 550 amino acids to about 900 amino acids, about 550 amino acids to about 850 amino acids, about 550 amino acids to about 800 amino acids, about 550 amino acids to about 750 amino acids, about 550 amino acids to about 700 amino acids, about 550 amino acids to about 650 amino acids, about 550 amino acids to about 600 amino acids, about 600 amino acids to about 1950 amino acids, about 600 amino acids to about 1900 amino acids, about 600 amino acids to about 1850 amino acids, about 600 amino acids to about 1800 amino acids, about 600 amino acids to about 1750 amino acids, about 600 amino acids to about 1700 amino acids, about 600 amino acids to about 1650 amino acids, about 600 amino acids to about 1600 amino acids, about 600 amino acids to about 1550 amino acids, about 600 amino acids to about 1500 amino acids, about 600 amino acids to about 1450 amino acids, about 600 amino acids to about 1400 amino acids, about 600 amino acids to about 1350 amino acids, about 600 amino acids to about 1300 amino acids, about 600 amino acids to about 1250 amino acids, about 600 amino acids to about 1200 amino acids, about 600 amino acids to about 1150 amino acids, about 600 amino acids to about 1100 amino acids, about 600 amino acids to about 1050 amino acids, about 600 amino acids to about 1000 amino acids, about 600 amino acids to about 950 amino acids, about 600 amino acids to about 900 amino acids, about 600 amino acids to about 850 amino acids, about 600 amino acids to about 800 amino acids, about 600 amino acids to about 750 amino acids, about 600 amino acids to about 700 amino acids, about 600 amino acids to about 650 amino acids, about 650 amino acids to about 1950 amino acids, about 650 amino acids to about 1900 amino acids, about 650 amino acids to about 1850 amino acids, about 650 amino acids to about 1800 amino acids, about 650 amino acids to about 1750 amino acids, about 650 amino acids to about 1700 amino acids, about 650 amino acids to about 1650 amino acids, about 650 amino acids to about 1600 amino acids, about 650 amino acids to about 1550 amino acids, about 650 amino acids to about 1500 amino acids, about 650 amino acids to about 1450 amino acids, about 650 amino acids to about 1400 amino acids, about 650 amino acids to about 1350 amino acids, about 650 amino acids to about 1300 amino acids, about 650 amino acids to about 1250 amino acids, about 650 amino acids to about 1200 amino acids, about 650 amino acids to about 1150 amino acids, about 650 amino acids to about 1100 amino acids, about 650 amino acids to about 1050 amino acids, about 650 amino acids to about 1000 amino acids, about 650 amino acids to about 950 amino acids, about 650 amino acids to about 900 amino acids, about 650 amino acids to about 850 amino acids, about 650 amino acids to about 800 amino acids, about 650 amino acids to about 750 amino acids, about 650 amino acids to about 700 amino acids, about 700 amino acids to about 1950 amino acids, about 700 amino acids to about 1900 amino acids, about 700 amino acids to about 1850 amino acids, about 700 amino acids to about 1800 amino acids, about 700 amino acids to about 1750 amino acids, about 700 amino acids to about 1700 amino acids, about 700 amino acids to about 1650 amino acids, about 700 amino acids to about 1600 amino acids, about 700 amino acids to about 1550 amino acids, about 700 amino acids to about 1500 amino acids, about 700 amino acids to about 1450 amino acids, about 700 amino acids to about 1400 amino acids, about 700 amino acids to about 1350 amino acids, about 700 amino acids to about 1300 amino acids, about 700 amino acids to about 1250 amino acids, about 700 amino acids to about 1200 amino acids, about 700 amino acids to about 1150 amino acids, about 700 amino acids to about 1100 amino acids, about 700 amino acids to about 1050 amino acids, about 700 amino acids to about 1000 amino acids, about 700 amino acids to about 950 amino acids, about 700 amino acids to about 900 amino acids, about 700 amino acids to about 850 amino acids, about 700 amino acids to about 800 amino acids, about 700 amino acids to about 750 amino acids, about 750 amino acids to about 1950 amino acids, about 750 amino acids to about 1900 amino acids, about 750 amino acids to about 1850 amino acids, about 750 amino acids to about 1800 amino acids, about 750 amino acids to about 1750 amino acids, about 750 amino acids to about 1700 amino acids, about 750 amino acids to about 1650 amino acids, about 750 amino acids to about 1600 amino acids, about 750 amino acids to about 1550 amino acids, about 750 amino acids to about 1500 amino acids, about 750 amino acids to about 1450 amino acids, about 750 amino acids to about 1400 amino acids, about 750 amino acids to about 1350 amino acids, about 750 amino acids to about 1300 amino acids, about 750 amino acids to about 1250 amino acids, about 750 amino acids to about 1200 amino acids, about 750 amino acids to about 1150 amino acids, about 750 amino acids to about 1100 amino acids, about 750 amino acids to about 1050 amino acids, about 750 amino acids to about 1000 amino acids, about 750 amino acids to about 950 amino acids, about 750 amino acids to about 900 amino acids, about 750 amino acids to about 850 amino acids, about 750 amino acids to about 800 amino acids, about 800 amino acids to about 1950 amino acids, about 800 amino acids to about 1900 amino acids, about 800 amino acids to about 1850 amino acids, about 800 amino acids to about 1800 amino acids, about 800 amino acids to about 1750 amino acids, about 800 amino acids to about 1700 amino acids, about 800 amino acids to about 1650 amino acids, about 800 amino acids to about 1600 amino acids, about 800 amino acids to about 1550 amino acids, about 800 amino acids to about 1500 amino acids, about 800 amino acids to about 1450 amino acids, about 800 amino acids to about 1400 amino acids, about 800 amino acids to about 1350 amino acids, about 800 amino acids to about 1300 amino acids, about 800 amino acids to about 1250 amino acids, about 800 amino acids to about 1200 amino acids, about 800 amino acids to about 1150 amino acids, about 800 amino acids to about 1100 amino acids, about 800 amino acids to about 1050 amino acids, about 800 amino acids to about 1000 amino acids, about 800 amino acids to about 950 amino acids, about 800 amino acids to about 900 amino acids, about 800 amino acids to about 850 amino acids, about 850 amino acids to about 1950 amino acids, about 850 amino acids to about 1900 amino acids, about 850 amino acids to about 1850 amino acids, about 850 amino acids to about 1800 amino acids, about 850 amino acids to about 1750 amino acids, about 850 amino acids to about 1700 amino acids, about 850 amino acids to about 1650 amino acids, about 850 amino acids to about 1600 amino acids, about 850 amino acids to about 1550 amino acids, about 850 amino acids to about 1500 amino acids, about 850 amino acids to about 1450 amino acids, about 850 amino acids to about 1400 amino acids, about 850 amino acids to about 1350 amino acids, about 850 amino acids to about 1300 amino acids, about 850 amino acids to about 1250 amino acids, about 850 amino acids to about 1200 amino acids, about 850 amino acids to about 1150 amino acids, about 850 amino acids to about 1100 amino acids, about 850 amino acids to about 1050 amino acids, about 850 amino acids to about 1000 amino acids, about 850 amino acids to about 950 amino acids, about 850 amino acids to about 900 amino acids, about 900 amino acids to about 1950 amino acids, about 900 amino acids to about 1900 amino acids, about 900 amino acids to about 1850 amino acids, about 900 amino acids to about 1800 amino acids, about 900 amino acids to about 1750 amino acids, about 900 amino acids to about 1700 amino acids, about 900 amino acids to about 1650 amino acids, about 900 amino acids to about 1600 amino acids, about 900 amino acids to about 1550 amino acids, about 900 amino acids to about 1500 amino acids, about 900 amino acids to about 1450 amino acids, about 900 amino acids to about 1400 amino acids, about 900 amino acids to about 1350 amino acids, about 900 amino acids to about 1300 amino acids, about 900 amino acids to about 1250 amino acids, about 900 amino acids to about 1200 amino acids, about 900 amino acids to about 1150 amino acids, about 900 amino acids to about 1100 amino acids, about 900 amino acids to about 1050 amino acids, about 900 amino acids to about 1000 amino acids, about 900 amino acids to about 950 amino acids, about 950 amino acids to about 1950 amino acids, about 950 amino acids to about 1900 amino acids, about 950 amino acids to about 1850 amino acids, about 950 amino acids to about 1800 amino acids, about 950 amino acids to about 1750 amino acids, about 950 amino acids to about 1700 amino acids, about 950 amino acids to about 1650 amino acids, about 950 amino acids to about 1600 amino acids, about 950 amino acids to about 1550 amino acids, about 950 amino acids to about 1500 amino acids, about 950 amino acids to about 1450 amino acids, about 950 amino acids to about 1400 amino acids, about 950 amino acids to about 1350 amino acids, about 950 amino acids to about 1300 amino acids, about 950 amino acids to about 1250 amino acids, about 950 amino acids to about 1200 amino acids, about 950 amino acids to about 1150 amino acids, about 950 amino acids to about 1100 amino acids, about 950 amino acids to about 1050 amino acids, about 950 amino acids to about 1000 amino acids, about 1000 amino acids to about 1950 amino acids, about 1000 amino acids to about 1900 amino acids, about 1000 amino acids to about 1850 amino acids, about 1000 amino acids to about 1800 amino acids, about 1000 amino acids to about 1750 amino acids, about 1000 amino acids to about 1700 amino acids, about 1000 amino acids to about 1650 amino acids, about 1000 amino acids to about 1600 amino acids, about 1000 amino acids to about 1550 amino acids, about 1000 amino acids to about 1500 amino acids, about 1000 amino acids to about 1450 amino acids, about 1000 amino acids to about 1400 amino acids, about 1000 amino acids to about 1350 amino acids, about 1000 amino acids to about 1300 amino acids, about 1000 amino acids to about 1250 amino acids, about 1000 amino acids to about 1200 amino acids, about 1000 amino acids to about 1150 amino acids, about 1000 amino acids to about 1100 amino acids, about 1000 amino acids to about 1050 amino acids, about 1050 amino acids to about 1950 amino acids, about 1050 amino acids to about 1900 amino acids, about 1050 amino acids to about 1850 amino acids, about 1050 amino acids to about 1800 amino acids, about 1050 amino acids to about 1750 amino acids, about 1050 amino acids to about 1700 amino acids, about 1050 amino acids to about 1650 amino acids, about 1050 amino acids to about 1600 amino acids, about 1050 amino acids to about 1550 amino acids, about 1050 amino acids to about 1500 amino acids, about 1050 amino acids to about 1450 amino acids, about 1050 amino acids to about 1400 amino acids, about 1050 amino acids to about 1350 amino acids, about 1050 amino acids to about 1300 amino acids, about 1050 amino acids to about 1250 amino acids, about 1050 amino acids to about 1200 amino acids, about 1050 amino acids to about 1150 amino acids, about 1050 amino acids to about 1100 amino acids, about 1100 amino acids to about 1950 amino acids, about 1100 amino acids to about 1900 amino acids, about 1100 amino acids to about 1850 amino acids, about 1100 amino acids to about 1800 amino acids, about 1100 amino acids to about 1750 amino acids, about 1100 amino acids to about 1700 amino acids, about 1100 amino acids to about 1650 amino acids, about 1100 amino acids to about 1600 amino acids, about 1100 amino acids to about 1550 amino acids, about 1100 amino acids to about 1500 amino acids, about 1100 amino acids to about 1450 amino acids, about 1100 amino acids to about 1400 amino acids, about 1100 amino acids to about 1350 amino acids, about 1100 amino acids to about 1300 amino acids, about 1100 amino acids to about 1250 amino acids, about 1100 amino acids to about 1200 amino acids, about 1100 amino acids to about 1150 amino acids, about 1150 amino acids to about 1950 amino acids, about 1150 amino acids to about 1900 amino acids, about 1150 amino acids to about 1850 amino acids, about 1150 amino acids to about 1800 amino acids, about 1150 amino acids to about 1750 amino acids, about 1150 amino acids to about 1700 amino acids, about 1150 amino acids to about 1650 amino acids, about 1150 amino acids to about 1600 amino acids, about 1150 amino acids to about 1550 amino acids, about 1150 amino acids to about 1500 amino acids, about 1150 amino acids to about 1450 amino acids, about 1150 amino acids to about 1400 amino acids, about 1150 amino acids to about 1350 amino acids, about 1150 amino acids to about 1300 amino acids, about 1150 amino acids to about 1250 amino acids, about 1150 amino acids to about 1200 amino acids, about 1200 amino acids to about 1950 amino acids, about 1200 amino acids to about 1900 amino acids, about 1200 amino acids to about 1850 amino acids, about 1200 amino acids to about 1800 amino acids, about 1200 amino acids to about 1750 amino acids, about 1200 amino acids to about 1700 amino acids, about 1200 amino acids to about 1650 amino acids, about 1200 amino acids to about 1600 amino acids, about 1200 amino acids to about 1550 amino acids, about 1200 amino acids to about 1500 amino acids, about 1200 amino acids to about 1450 amino acids, about 1200 amino acids to about 1400 amino acids, about 1200 amino acids to about 1350 amino acids, about 1200 amino acids to about 1300 amino acids, about 1200 amino acids to about 1250 amino acids, about 1250 amino acids to about 1950 amino acids, about 1250 amino acids to about 1900 amino acids, about 1250 amino acids to about 1850 amino acids, about 1250 amino acids to about 1800 amino acids, about 1250 amino acids to about 1750 amino acids, about 1250 amino acids to about 1700 amino acids, about 1250 amino acids to about 1650 amino acids, about 1250 amino acids to about 1600 amino acids, about 1250 amino acids to about 1550 amino acids, about 1250 amino acids to about 1500 amino acids, about 1250 amino acids to about 1450 amino acids, about 1250 amino acids to about 1400 amino acids, about 1250 amino acids to about 1350 amino acids, about 1250 amino acids to about 1300 amino acids, about 1300 amino acids to about 1950 amino acids, about 1300 amino acids to about 1900 amino acids, about 1300 amino acids to about 1850 amino acids, about 1300 amino acids to about 1800 amino acids, about 1300 amino acids to about 1750 amino acids, about 1300 amino acids to about 1700 amino acids, about 1300 amino acids to about 1650 amino acids, about 1300 amino acids to about 1600 amino acids, about 1300 amino acids to about 1550 amino acids, about 1300 amino acids to about 1500 amino acids, about 1300 amino acids to about 1450 amino acids, about 1300 amino acids to about 1400 amino acids, about 1300 amino acids to about 1350 amino acids, about 1350 amino acids to about 1950 amino acids, about 1350 amino acids to about 1900 amino acids, about 1350 amino acids to about 1850 amino acids, about 1350 amino acids to about 1800 amino acids, about 1350 amino acids to about 1750 amino acids, about 1350 amino acids to about 1700 amino acids, about 1350 amino acids to about 1650 amino acids, about 1350 amino acids to about 1600 amino acids, about 1350 amino acids to about 1550 amino acids, about 1350 amino acids to about 1500 amino acids, about 1350 amino acids to about 1450 amino acids, about 1350 amino acids to about 1400 amino acids, about 1400 amino acids to about 1950 amino acids, about 1400 amino acids to about 1900 amino acids, about 1400 amino acids to about 1850 amino acids, about 1400 amino acids to about 1800 amino acids, about 1400 amino acids to about 1750 amino acids, about 1400 amino acids to about 1700 amino acids, about 1400 amino acids to about 1650 amino acids, about 1400 amino acids to about 1600 amino acids, about 1400 amino acids to about 1550 amino acids, about 1400 amino acids to about 1500 amino acids, about 1400 amino acids to about 1450 amino acids, about 1450 amino acids to about 1950 amino acids, about 1450 amino acids to about 1900 amino acids, about 1450 amino acids to about 1850 amino acids, about 1450 amino acids to about 1800 amino acids, about 1450 amino acids to about 1750 amino acids, about 1450 amino acids to about 1700 amino acids, about 1450 amino acids to about 1650 amino acids, about 1450 amino acids to about 1600 amino acids, about 1450 amino acids to about 1550 amino acids, about 1450 amino acids to about 1500 amino acids, about 1600 amino acids to about 1950 amino acids, about 1600 amino acids to about 1900 amino acids, about 1600 amino acids to about 1850 amino acids, about 1600 amino acids to about 1800 amino acids, about 1600 amino acids to about 1750 amino acids, about 1600 amino acids to about 1700 amino acids, about 1600 amino acids to about 1650 amino acids, about 1500 amino acids to about 1950 amino acids, about 1500 amino acids to about 1900 amino acids, about 1500 amino acids to about 1850 amino acids, about 1500 amino acids to about 1800 amino acids, about 1500 amino acids to about 1750 amino acids, about 1500 amino acids to about 1700 amino acids, about 1500 amino acids to about 1650 amino acids, about 1500 amino acids to about 1600 amino acids, about 1500 amino acids to about 1550 amino acids, about 1550 amino acids to about 1950 amino acids, about 1550 amino acids to about 1900 amino acids, about 1550 amino acids to about 1850 amino acids, about 1550 amino acids to about 1800 amino acids, about 1550 amino acids to about 1750 amino acids, about 1550 amino acids to about 1700 amino acids, about 1550 amino acids to about 1650 amino acids, about 1550 amino acids to about 1600 amino acids, about 1600 amino acids to about 1950 amino acids, about 1600 amino acids to about 1900 amino acids, about 1600 amino acids to about 1850 amino acids, about 1600 amino acids to about 1800 amino acids, about 1600 amino acids to about 1750 amino acids, about 1600 amino acids to about 1700 amino acids, about 1600 amino acids to about 1650 amino acids, about 1650 amino acids to about 1950 amino acids, about 1650 amino acids to about 1900 amino acids, about 1650 amino acids to about 1850 amino acids, about 1650 amino acids to about 1800 amino acids, about 1650 amino acids to about 1750 amino acids, about 1650 amino acids to about 1700 amino acids, about 1700 amino acids to about 1950 amino acids, about 1700 amino acids to about 1900 amino acids, about 1700 amino acids to about 1850 amino acids, about 1700 amino acids to about 1800 amino acids, about 1700 amino acids to about 1750 amino acids, about 1750 amino acids to about 1950 amino acids, about 1750 amino acids to about 1900 amino acids, about 1750 amino acids to about 1850 amino acids, about 1750 amino acids to about 1800 amino acids, about 1800 amino acids to about 1950 amino acids, about 1800 amino acids to about 1900 amino acids, about 1800 amino acids to about 1850 amino acids, about 1850 amino acids to about 1950 amino acids, about 1850 amino acids to about 1900 amino acids, about 1900 amino acids to about 1950 amino acids), wherein the amino acid sequence of each of the encoded portions may optionally partially overlap with the amino acid sequence of a different one of the encoded portions; no single vector of the at least two different vectors encodes an active otoferlin protein (e.g., a full-length otoferlin protein (e.g., a full-length wildtype otoferlin protein)); and, when introduced into a mammalian cell, the at least two different vectors undergo homologous recombination with each other, thereby forming a recombined nucleic acid, where the recombined nucleic acid encodes an active otoferlin protein (e.g., a full-length otoferlin protein). In some embodiments, one of the nucleic acid vectors can include a coding sequence that encodes a portion of an otoferlin protein, where the encoded portion is, e.g., about 900 amino acids to about 1950 amino acids, about 900 amino acids to about 1900 amino acids, about 900 amino acids to about 1850 amino acids, about 900 amino acids to about 1800 amino acids, about 900 amino acids to about 1750 amino acids, about 900 amino acids to about 1700 amino acids, about 900 amino acids to about 1650 amino acids, about 900 amino acids to about 1600 amino acids, about 900 amino acids to about 1550 amino acids, about 900 amino acids to about 1500 amino acids, about 900 amino acids to about 1450 amino acids, about 900 amino acids to about 1400 amino acids, about 900 amino acids to about 1350 amino acids, about 900 amino acids to about 1300 amino acids, about 900 amino acids to about 1250 amino acids, about 900 amino acids to about 1200 amino acids, about 900 amino acids to about 1150 amino acids, about 900 amino acids to about 1100 amino acids, about 900 amino acids to about 1050 amino acids, about 900 amino acids to about 1000 amino acids, about 900 amino acids to about 950 amino acids, about 950 amino acids to about 1950 amino acids, about 950 amino acids to about 1900 amino acids, about 950 amino acids to about 1850 amino acids, about 950 amino acids to about 1800 amino acids, about 950 amino acids to about 1750 amino acids, about 950 amino acids to about 1700 amino acids, about 950 amino acids to about 1650 amino acids, about 950 amino acids to about 1600 amino acids, about 950 amino acids to about 1550 amino acids, about 950 amino acids to about 1500 amino acids, about 950 amino acids to about 1450 amino acids, about 950 amino acids to about 1400 amino acids, about 950 amino acids to about 1350 amino acids, about 950 amino acids to about 1300 amino acids, about 950 amino acids to about 1250 amino acids, about 950 amino acids to about 1200 amino acids, about 950 amino acids to about 1150 amino acids, about 950 amino acids to about 1100 amino acids, about 950 amino acids to about 1050 amino acids, about 950 amino acids to about 1000 amino acids, about 1000 amino acids to about 1950 amino acids, about 1000 amino acids to about 1900 amino acids, about 1000 amino acids to about 1850 amino acids, about 1000 amino acids to about 1800 amino acids, about 1000 amino acids to about 1750 amino acids, about 1000 amino acids to about 1700 amino acids, about 1000 amino acids to about 1650 amino acids, about 1000 amino acids to about 1600 amino acids, about 1000 amino acids to about 1550 amino acids, about 1000 amino acids to about 1500 amino acids, about 1000 amino acids to about 1450 amino acids, about 1000 amino acids to about 1400 amino acids, about 1000 amino acids to about 1350 amino acids, about 1000 amino acids to about 1300 amino acids, about 1000 amino acids to about 1250 amino acids, about 1000 amino acids to about 1200 amino acids, about 1000 amino acids to about 1150 amino acids, about 1000 amino acids to about 1100 amino acids, about 1000 amino acids to about 1050 amino acids, about 1050 amino acids to about 1950 amino acids, about 1050 amino acids to about 1900 amino acids, about 1050 amino acids to about 1850 amino acids, about 1050 amino acids to about 1800 amino acids, about 1050 amino acids to about 1750 amino acids, about 1050 amino acids to about 1700 amino acids, about 1050 amino acids to about 1650 amino acids, about 1050 amino acids to about 1600 amino acids, about 1050 amino acids to about 1550 amino acids, about 1050 amino acids to about 1500 amino acids, about 1050 amino acids to about 1450 amino acids, about 1050 amino acids to about 1400 amino acids, about 1050 amino acids to about 1350 amino acids, about 1050 amino acids to about 1300 amino acids, about 1050 amino acids to about 1250 amino acids, about 1050 amino acids to about 1200 amino acids, about 1050 amino acids to about 1150 amino acids, about 1050 amino acids to about 1100 amino acids, about 1100 amino acids to about 1950 amino acids, about 1100 amino acids to about 1900 amino acids, about 1100 amino acids to about 1850 amino acids, about 1100 amino acids to about 1800 amino acids, about 1100 amino acids to about 1750 amino acids, about 1100 amino acids to about 1700 amino acids, about 1100 amino acids to about 1650 amino acids, about 1100 amino acids to about 1600 amino acids, about 1100 amino acids to about 1550 amino acids, about 1100 amino acids to about 1500 amino acids, about 1100 amino acids to about 1450 amino acids, about 1100 amino acids to about 1400 amino acids, about 1100 amino acids to about 1350 amino acids, about 1100 amino acids to about 1300 amino acids, about 1100 amino acids to about 1250 amino acids, about 1100 amino acids to about 1200 amino acids, about 1100 amino acids to about 1150 amino acids, about 1150 amino acids to about 1950 amino acids, about 1150 amino acids to about 1900 amino acids, about 1150 amino acids to about 1850 amino acids, about 1150 amino acids to about 1800 amino acids, about 1150 amino acids to about 1750 amino acids, about 1150 amino acids to about 1700 amino acids, about 1150 amino acids to about 1650 amino acids, about 1150 amino acids to about 1600 amino acids, about 1150 amino acids to about 1550 amino acids, about 1150 amino acids to about 1500 amino acids, about 1150 amino acids to about 1450 amino acids, about 1150 amino acids to about 1400 amino acids, about 1150 amino acids to about 1350 amino acids, about 1150 amino acids to about 1300 amino acids, about 1150 amino acids to about 1250 amino acids, about 1150 amino acids to about 1200 amino acids, about 1200 amino acids to about 1950 amino acids, about 1200 amino acids to about 1900 amino acids, about 1200 amino acids to about 1850 amino acids, about 1200 amino acids to about 1800 amino acids, about 1200 amino acids to about 1750 amino acids, about 1200 amino acids to about 1700 amino acids, about 1200 amino acids to about 1650 amino acids, about 1200 amino acids to about 1600 amino acids, about 1200 amino acids to about 1550 amino acids, about 1200 amino acids to about 1500 amino acids, about 1200 amino acids to about 1450 amino acids, about 1200 amino acids to about 1400 amino acids, about 1200 amino acids to about 1350 amino acids, about 1200 amino acids to about 1300 amino acids, about 1200 amino acids to about 1250 amino acids, about 1250 amino acids to about 1950 amino acids, about 1250 amino acids to about 1900 amino acids, about 1250 amino acids to about 1850 amino acids, about 1250 amino acids to about 1800 amino acids, about 1250 amino acids to about 1750 amino acids, about 1250 amino acids to about 1700 amino acids, about 1250 amino acids to about 1650 amino acids, about 1250 amino acids to about 1600 amino acids, about 1250 amino acids to about 1550 amino acids, about 1250 amino acids to about 1500 amino acids, about 1250 amino acids to about 1450 amino acids, about 1250 amino acids to about 1400 amino acids, about 1250 amino acids to about 1350 amino acids, about 1250 amino acids to about 1300 amino acids, about 1300 amino acids to about 1950 amino acids, about 1300 amino acids to about 1900 amino acids, about 1300 amino acids to about 1850 amino acids, about 1300 amino acids to about 1800 amino acids, about 1300 amino acids to about 1750 amino acids, about 1300 amino acids to about 1700 amino acids, about 1300 amino acids to about 1650 amino acids, about 1300 amino acids to about 1600 amino acids, about 1300 amino acids to about 1550 amino acids, about 1300 amino acids to about 1500 amino acids, about 1300 amino acids to about 1450 amino acids, about 1300 amino acids to about 1400 amino acids, about 1300 amino acids to about 1350 amino acids, about 1350 amino acids to about 1950 amino acids, about 1350 amino acids to about 1900 amino acids, about 1350 amino acids to about 1850 amino acids, about 1350 amino acids to about 1800 amino acids, about 1350 amino acids to about 1750 amino acids, about 1350 amino acids to about 1700 amino acids, about 1350 amino acids to about 1650 amino acids, about 1350 amino acids to about 1600 amino acids, about 1350 amino acids to about 1550 amino acids, about 1350 amino acids to about 1500 amino acids, about 1350 amino acids to about 1450 amino acids, about 1350 amino acids to about 1400 amino acids, about 1400 amino acids to about 1950 amino acids, about 1400 amino acids to about 1900 amino acids, about 1400 amino acids to about 1850 amino acids, about 1400 amino acids to about 1800 amino acids, about 1400 amino acids to about 1750 amino acids, about 1400 amino acids to about 1700 amino acids, about 1400 amino acids to about 1650 amino acids, about 1400 amino acids to about 1600 amino acids, about 1400 amino acids to about 1550 amino acids, about 1400 amino acids to about 1500 amino acids, about 1400 amino acids to about 1450 amino acids, about 1450 amino acids to about 1950 amino acids, about 1450 amino acids to about 1900 amino acids, about 1450 amino acids to about 1850 amino acids, about 1450 amino acids to about 1800 amino acids, about 1450 amino acids to about 1750 amino acids, about 1450 amino acids to about 1700 amino acids, about 1450 amino acids to about 1650 amino acids, about 1450 amino acids to about 1600 amino acids, about 1450 amino acids to about 1550 amino acids, about 1450 amino acids to about 1500 amino acids, about 1500 amino acids to about 1950 amino acids, about 1500 amino acids to about 1900 amino acids, about 1500 amino acids to about 1850 amino acids, about 1500 amino acids to about 1800 amino acids, about 1500 amino acids to about 1750 amino acids, about 1500 amino acids to about 1700 amino acids, about 1500 amino acids to about 1650 amino acids, about 1500 amino acids to about 1600 amino acids, about 1500 amino acids to about 1550 amino acids, about 1550 amino acids to about 1950 amino acids, about 1550 amino acids to about 1900 amino acids, about 1550 amino acids to about 1850 amino acids, about 1550 amino acids to about 1800 amino acids, about 1550 amino acids to about 1750 amino acids, about 1550 amino acids to about 1700 amino acids, about 1550 amino acids to about 1650 amino acids, about 1550 amino acids to about 1600 amino acids, about 1600 amino acids to about 1950 amino acids, about 1600 amino acids to about 1900 amino acids, about 1600 amino acids to about 1850 amino acids, about 1600 amino acids to about 1800 amino acids, about 1600 amino acids to about 1750 amino acids, about 1600 amino acids to about 1700 amino acids, about 1600 amino acids to about 1650 amino acids, about 1650 amino acids to about 1950 amino acids, about 1650 amino acids to about 1900 amino acids, about 1650 amino acids to about 1850 amino acids, about 1650 amino acids to about 1800 amino acids, about 1650 amino acids to about 1750 amino acids, about 1650 amino acids to about 1700 amino acids, about 1700 amino acids to about 1950 amino acids, about 1700 amino acids to about 1900 amino acids, about 1700 amino acids to about 1850 amino acids, about 1700 amino acids to about 1800 amino acids, about 1700 amino acids to about 1750 amino acids, about 1750 amino acids to about 1950 amino acids, about 1750 amino acids to about 1900 amino acids, about 1750 amino acids to about 1850 amino acids, about 1750 amino acids to about 1800 amino acids, about 1800 amino acids to about 1950 amino acids, about 1800 amino acids to about 1900 amino acids, about 1800 amino acids to about 1850 amino acids, about 1850 amino acids to about 1950 amino acids, about 1850 amino acids to about 1900 amino acids, or about 1900 amino acids to about 1950 amino acids in length.

In some embodiments of these compositions, at least one of the coding sequences includes a nucleotide sequence spanning two neighboring exons of otoferlin genomic DNA, and lacks the intronic sequence that naturally occurs between the two neighboring exons.

In some embodiments, the amino acid sequence of none of the encoded portions overlaps even in part with the amino acid sequence of a different one of the encoded portions. In some embodiments, the amino acid sequence of one or more of the encoded portions partially overlaps with the amino acid sequence of a different one of the encoded portions. In some embodiments, the amino acid sequence of each of the encoded portions partially overlaps with the amino acid sequence of a different one of the encoded portions.

In some embodiments, the overlapping amino acid sequence is between about 30 amino acid residues to about 1000 amino acids (e.g., or any of the subranges of this range described herein) in length.

In some examples, the vectors include two different vectors, each of which comprises not only exon(s), but also a different segment of an intron, wherein the intron includes the nucleotide sequence of an intron that is present in an otoferlin genomic DNA (e.g., any of the exemplary introns in SEQ ID NO: 12 described herein), and wherein the two different segments overlap in sequence by at least 100 nucleotides (e.g., about 100 nucleotides to about 5,000 nucleotides, about 100 nucleotides to about 4,500 nucleotides, about 100 nucleotides to about 4,000 nucleotides, about 100 nucleotides to about 3,500 nucleotides, about 100 nucleotides to about 3,000 nucleotides, about 100 nucleotides to about 2,500 nucleotides, about 100 nucleotides to about 2,000 nucleotides, about 100 nucleotides to about 1,500 nucleotides, about 100 nucleotides to about 1,000 nucleotides, about 100 nucleotides to about 800 nucleotides, about 100 nucleotides to about 600 nucleotides, about 100 nucleotides to about 400 nucleotides, about 100 nucleotides to about 200 nucleotides, about 200 nucleotides to about 5,000 nucleotides, about 200 nucleotides to about 4,500 nucleotides, about 200 nucleotides to about 4,000 nucleotides, about 200 nucleotides to about 3,500 nucleotides, about 200 nucleotides to about 3,000 nucleotides, about 200 nucleotides to about 2,500 nucleotides, about 200 nucleotides to about 2,000 nucleotides, about 200 nucleotides to about 1,500 nucleotides, about 200 nucleotides to about 1,000 nucleotides, about 200 nucleotides to about 800 nucleotides, about 200 nucleotides to about 600 nucleotides, about 200 nucleotides to about 400 nucleotides, about 400 nucleotides to about 5,000 nucleotides, about 400 nucleotides to about 4,500 nucleotides, about 400 nucleotides to about 4,000 nucleotides, about 400 nucleotides to about 3,500 nucleotides, about 400 nucleotides to about 3,000 nucleotides, about 400 nucleotides to about 2,500 nucleotides, about 400 nucleotides to about 2,000 nucleotides, about 400 nucleotides to about 1,500 nucleotides, about 400 nucleotides to about 1,000 nucleotides, about 400 nucleotides to about 800 nucleotides, about 400 nucleotides to about 600 nucleotides, about 600 nucleotides to about 5,000 nucleotides, about 600 nucleotides to about 4,500 nucleotides, about 600 nucleotides to about 4,000 nucleotides, about 600 nucleotides to about 3,500 nucleotides, about 600 nucleotides to about 3,000 nucleotides, about 600 nucleotides to about 2,500 nucleotides, about 600 nucleotides to about 2,000 nucleotides, about 600 nucleotides to about 1,500 nucleotides, about 600 nucleotides to about 1,000 nucleotides, about 600 nucleotides to about 800 nucleotides, about 800 nucleotides to about 5,000 nucleotides, about 800 nucleotides to about 4,500 nucleotides, about 800 nucleotides to about 4,000 nucleotides, about 800 nucleotides to about 3,500 nucleotides, about 800 nucleotides to about 3,000 nucleotides, about 800 nucleotides to about 2,500 nucleotides, about 800 nucleotides to about 2,000 nucleotides, about 800 nucleotides to about 1,500 nucleotides, about 800 nucleotides to about 1,000 nucleotides, about 1,000 nucleotides to about 5,000 nucleotides, about 1,000 nucleotides to about 4,500 nucleotides, about 1,000 nucleotides to about 4,000 nucleotides, about 1,000 nucleotides to about 3,500 nucleotides, about 1,000 nucleotides to about 3,000 nucleotides, about 1,000 nucleotides to about 2,500 nucleotides, about 1,000 nucleotides to about 2,000 nucleotides, about 1,000 nucleotides to about 1,500 nucleotides, about 1,500 nucleotides to about 5,000 nucleotides, about 1,500 nucleotides to about 4,500 nucleotides, about 1,500 nucleotides to about 4,000 nucleotides, about 1,500 nucleotides to about 3,500 nucleotides, about 1,500 nucleotides to about 3,000 nucleotides, about 1,500 nucleotides to about 2,500 nucleotides, about 1,500 nucleotides to about 2,000 nucleotides, about 2,000 nucleotides to about 5,000 nucleotides, about 2,000 nucleotides to about 4,500 nucleotides, about 2,000 nucleotides to about 4,000 nucleotides, about 2,000 nucleotides to about 3,500 nucleotides, about 2,000 nucleotides to about 3,000 nucleotides, about 2,000 nucleotides to about 2,500 nucleotides, about 2,500 nucleotides to about 5,000 nucleotides, about 2,500 nucleotides to about 4,500 nucleotides, about 2,500 nucleotides to about 4,000 nucleotides, about 2,500 nucleotides to about 3,500 nucleotides, about 2,500 nucleotides to about 3,000 nucleotides, about 3,000 nucleotides to about 5,000 nucleotides, about 3,000 nucleotides to about 4,500 nucleotides, about 3,000 nucleotides to about 4,000 nucleotides, about 3,000 nucleotides to about 3,500 nucleotides, about 3,500 nucleotides to about 5,000 nucleotides, about 3,500 nucleotides to about 4,500 nucleotides, about 3,500 nucleotides to about 4,000 nucleotides, about 4,000 nucleotides to about 5,000 nucleotides, about 4,000 nucleotides to about 4,500 nucleotides, about 4,500 nucleotides to about 5,000 nucleotides), in length.

The overlapping nucleotide sequence in any two of the different vectors can include part or all of one or more exons of an otoferlin gene (e.g., any one or more of the exemplary exons in SEQ ID NO: 12 described herein).

In some embodiments, the number of different vectors in the composition is two, three, four, or five. In compositions where the number of different vectors in the composition is two, the first of the two different vectors can include a coding sequence that encodes an N-terminal portion of the otoferlin protein. In some examples, the N-terminal portion of the otoferlin gene is between about 30 amino acids to about 1950 amino acids (or any of the subranges of this range described above) in length. In some examples, the first vector further includes one or both of a promoter (e.g., any of the promoters described herein or known in the art) and a Kozak sequence (e.g., any of the exemplary Kozak sequences described herein or known in the art). In some examples, the first vector includes a promoter that is an inducible promoter, a constitutive promoter, or a tissue-specific promoter. In some examples, the second of the two different vectors includes a coding sequence that encodes a C-terminal portion of the otoferlin protein. In some examples, the C-terminal portion of the otoferlin protein is between 30 amino acids to about 1950 amino acids (or any of the subranges of this range described above) in length. In some examples, the second vector further includes a poly(A) signal sequence.

In some examples where the number of different vectors in the composition is two, the N-terminal portion encoded by one of the two vectors can include a portion comprising amino acid position 1 to about amino acid position 1,950, about amino acid position 1,940, about amino acid position 1,930, about amino acid position 1,920, about amino acid position 1,910, about amino acid position 1,900, about amino acid position 1,900, about amino acid position 1,890, about amino acid position 1,880, about amino acid position 1,870, about amino acid position 1,860, about amino acid position 1,850, about amino acid position 1,840, about amino acid position 1,830, about amino acid position 1,820, about amino acid position 1,810, about amino acid position 1,800, about amino acid position 1,790, about amino acid position 1,780, about amino acid position 1,770, about amino acid position 1,760, about amino acid position 1,750, about amino acid position 1,740, about amino acid position 1,730, about amino acid position 1,720, about amino acid position 1,710, about amino acid position 1,700, about amino acid position, about amino acid position 1,690, about amino acid position 1,680, about amino acid position 1,670, about amino acid position 1,660, about amino acid position 1,650, about amino acid position 1,640, about amino acid position 1,630, about amino acid position 1,620, about amino acid position 1,610, about amino acid position 1,600, about amino acid position 1,590, about amino acid position 1,580, about amino acid position 1,570, about amino acid position 1,560, about amino acid position 1,550, about amino acid position 1,540, about amino acid position 1,530, about amino acid position 1,520, about amino acid position 1,510, amino acid position 1 to about amino acid position 1,500, about amino acid position 1,490, about amino acid position 1,480, about amino acid position 1,470, about amino acid position 1,460, about amino acid position 1,450, about amino acid position 1,440, about amino acid position 1,430, about amino acid position 1,420, about amino acid position 1,410, about amino acid position 1,400, about amino acid position 1,390, about amino acid position 1,380, about amino acid position 1,370, about amino acid position 1,360, about amino acid position 1,350, about amino acid position 1,340, about amino acid position 1,330, about amino acid position 1,320, about amino acid position 1,310, about amino acid position 1,300, about amino acid position 1,290, about amino acid position 1,280, about amino acid position 1,270, about amino acid position 1,260, about amino acid position 1,250, about amino acid position 1,240, about amino acid position 1,230, about amino acid position 1,220, about amino acid position 1,210, about amino acid position 1,200, about amino acid position 1,190, about amino acid position 1,180, about amino acid position 1,170, about amino acid position 1,160, about amino acid position 1,150, about amino acid position 1,140, about amino acid position 1,130, about amino acid position 1,120, about amino acid position 1,110, about amino acid position 1,100, about amino acid position 1,090, about amino acid position 1,080, about amino acid position 1,070, about amino acid position 1,060, about amino acid position 1,050, about amino acid position 1,040, about amino acid position 1,030, about amino acid position 1,020, about amino acid position 1,010, about amino acid position 1,000, about amino acid position 990, about amino acid position 980, about amino acid position 970, about amino acid position 960, about amino acid position 950, about amino acid position 940, about amino acid position 930, about amino acid position 920, about amino acid position 910, about amino acid position 900, about amino acid position 890, about amino acid position 880, about amino acid position 870, about amino acid position 860, about amino acid position 850, about amino acid position 840, about amino acid position 830, about amino acid position 820, about amino acid position 810, about amino acid position 800, about amino acid position 790, about amino acid position 780, about amino acid position 770, about amino acid position 760, about amino acid position 750, about amino acid position 740, about amino acid position 730, about amino acid position 720, about amino acid position 710, about amino acid position 700, about amino acid position 690, about amino acid position 680, about amino acid position 670, about amino acid position 660, about amino acid position 650, about amino acid position 640, about amino acid position 630, about amino acid position 620, about amino acid position 610, about amino acid position 600, about amino acid position 590, about amino acid position 580, about amino acid position 570, about amino acid position 560, about amino acid position 550, about amino acid position 540, about amino acid position 530, about amino acid position 520, about amino acid position 510, about amino acid position 500, about amino acid position 490, about amino acid position 480, about amino acid position 470, about amino acid position 460, about amino acid position 450, about amino acid position 440, about amino acid position 430, about amino acid position 420, about amino acid position 410, about amino acid position 400, about amino acid position 390, about amino acid position 380, about amino acid position 370, about amino acid position 360, about amino acid position 350, about amino acid position 340, about amino acid position 330, about amino acid position 320, about amino acid position 310, about amino acid position 300, about amino acid position 290, about amino acid position 280, about amino acid position 270, about amino acid position 260, about amino acid position 250, about amino acid position 240, about amino acid position 230, about amino acid position 220, about amino acid position 210, about amino acid position 200, about amino acid position 190, about amino acid position 180, about amino acid position 170, about amino acid position 160, about amino acid position 150, about amino acid position 140, about amino acid position 130, about amino acid position 120, about amino acid position 110, about amino acid position 100, about amino acid position 90, about amino acid position 80, about amino acid position 70, about amino acid position 60, about amino acid position 50, or about amino acid position 40 of a wildtype otoferlin protein (e.g., SEQ ID NO: 5).

In some examples where the number of different vectors in the composition is two, the N-terminal portion of the precursor otoferlin protein can include a portion comprising amino acid position 1 to amino acid position 310, amino acid position 1 to about amino acid position 320, amino acid position 1 to about amino acid position 330, amino acid position 1 to about amino acid position 340, amino acid position 1 to about amino acid position 350, amino acid position 1 to about amino acid position 360, amino acid position 1 to about amino acid position 370, amino acid position 1 to about amino acid position 380, amino acid position 1 to about amino acid position 390, amino acid position 1 to about amino acid position 400, amino acid position 1 to about amino acid position 410, amino acid position 1 to about amino acid position 420, amino acid position 1 to about amino acid position 430, amino acid position 1 to about amino acid position 440, amino acid position 1 to about amino acid position 450, amino acid position 1 to about amino acid position 460, amino acid position 1 to about amino acid position 470, amino acid position 1 to about amino acid position 480, amino acid position 1 to about amino acid position 490, amino acid position 1 to about amino acid position 500, amino acid position 1 to about amino acid position 510, amino acid position 1 to about amino acid position 520, amino acid position 1 to about amino acid position 530, amino acid position 1 to about amino acid position 540, amino acid position 1 to about amino acid position 550, amino acid position 1 to about amino acid position 560, amino acid position 1 to about amino acid position 570, amino acid position 1 to about amino acid position 580, amino acid position 1 to about amino acid position 590, amino acid position 1 to about amino acid position 600, amino acid position 1 to about amino acid position 610, amino acid position 1 to about amino acid position 620, amino acid position 1 to about amino acid position 630, amino acid position 1 to about amino acid position 640, amino acid position 1 to about amino acid position 650, amino acid position 1 to about amino acid position 660, amino acid position 1 to about amino acid position 670, amino acid position 1 to about amino acid position 680, amino acid position 1 to about amino acid position 690, amino acid position 1 to about amino acid position 700, amino acid position 1 to about amino acid position 710, amino acid position 1 to about amino acid position 720, amino acid position 1 to about amino acid position 730, amino acid position 1 to about amino acid position 740, amino acid position 1 to about amino acid position 750, amino acid position 1 to about amino acid position 760, amino acid position 1 to about amino acid position 770, amino acid position 1 to about amino acid position 780, amino acid position 1 to about amino acid position 790, amino acid position 1 to about amino acid position 800, amino acid position 1 to about amino acid position 810, amino acid position 1 to about amino acid position 820, amino acid position 1 to about amino acid position 830, amino acid position 1 to about amino acid position 840, amino acid position 1 to about amino acid position 850, amino acid position 1 to about amino acid position 860, amino acid position 1 to about amino acid position 870, amino acid position 1 to about amino acid position 880, amino acid position 1 to about amino acid position 890, amino acid position 1 to about amino acid position 900, amino acid position 1 to about amino acid position 910, amino acid position 1 to about amino acid position 920, amino acid position 1 to about amino acid position 930, amino acid position 1 to about amino acid position 940, amino acid position 1 to about amino acid position 950, amino acid position 1 to about amino acid position 960, amino acid position 1 to about amino acid position 970, amino acid position 1 to about amino acid position 980, amino acid position 1 to about amino acid position 990, amino acid position 1 to about amino acid position 1,000, amino acid position 1 to about amino acid position 1,010, amino acid position 1 to about amino acid position 1,020, amino acid position 1 to about amino acid position 1,030, amino acid position 1 to about amino acid position 1,040, amino acid position 1 to about amino acid position 1,050, amino acid position 1 to about amino acid position 1,060, amino acid position 1 to about amino acid position 1,070, amino acid position 1 to about amino acid position 1,080, amino acid position 1 to about amino acid position 1,090, amino acid position 1 to about amino acid position 1,100, amino acid position 1 to about amino acid position 1,110, amino acid position 1 to about amino acid position 1,120, amino acid position 1 to about amino acid position 1,130, amino acid position 1 to about amino acid position 1,140, amino acid position 1 to about amino acid position 1,150, amino acid position 1 to about amino acid position 1,160, amino acid position 1 to about amino acid position 1,170, amino acid position 1 to about amino acid position 1,180, amino acid position 1 to about amino acid position 1,190, amino acid position 1 to about amino acid position 1,200, amino acid position 1 to about amino acid position 1,210, amino acid position 1 to about amino acid position 1,220, amino acid position 1 to about amino acid position 1,230, amino acid position 1 to about amino acid position 1,240, amino acid position 1 to about amino acid position 1,250, amino acid position 1 to about amino acid position 1,260, amino acid position 1 to about amino acid position 1,270, amino acid position 1 to about amino acid position 1,280, amino acid position 1 to about amino acid position 1,290, amino acid position 1 to about amino acid position 1,300, amino acid position 1 to about amino acid position 1,310, amino acid position 1 to about amino acid position 1,320, amino acid position 1 to about amino acid position 1,330, amino acid position 1 to about amino acid position 1,340, amino acid position 1 to about amino acid position 1,350, amino acid position 1 to about amino acid position 1,360, amino acid position 1 to about amino acid position 1,370, amino acid position 1 to about amino acid position 1,380, amino acid position 1 to about amino acid position 1,390, amino acid position 1 to about amino acid position 1,400, amino acid position 1 to about amino acid position 1,410, amino acid position 1 to about amino acid position 1,420, amino acid position 1 to about amino acid position 1,430, amino acid position 1 to about amino acid position 1,440, amino acid position 1 to about amino acid position 1,450, amino acid position 1 to about amino acid position 1,460, amino acid position 1 to about amino acid position 1,470, amino acid position 1 to about amino acid position 1,480, amino acid position 1 to about amino acid position 1,490, amino acid position 1 to about amino acid position 1,500, amino acid position 1 to about amino acid position 1,510, amino acid position 1 to about amino acid position 1,520, amino acid position 1 to about amino acid position 1,530, amino acid position 1 to about amino acid position 1,540, amino acid position 1 to about amino acid position 1,550, amino acid position 1 to about amino acid position 1,560, amino acid position 1 to about amino acid position 1,570, amino acid position 1 to about amino acid position 1,580, amino acid position 1 to about amino acid position 1,590, amino acid position 1 to about amino acid position 1,600, amino acid position 1 to about amino acid 1,610, amino acid position 1 to about amino acid 1,620, amino acid position 1 to about amino acid 1,630, amino acid position 1 to about amino acid 1,640, amino acid position 1 to about amino acid 1,650, amino acid position 1 to about amino acid 1,660, amino acid position 1 to about amino acid 1,670, amino acid position 1 to about amino acid 1,680, amino acid position 1 to about amino acid 1,690, amino acid position 1 to about amino acid 1,700, amino acid position 1 to about amino acid 1,710, amino acid position 1 to about amino acid 1,720, amino acid position 1 to about amino acid 1,730, amino acid position 1 to about amino acid 1,740, amino acid position 1 to about amino acid 1,750, amino acid position 1 to about amino acid 1,760, amino acid position 1 to about amino acid 1,770, amino acid position 1 to about amino acid 1,780, amino acid position 1 to about amino acid 1,790, amino acid position 1 to about amino acid 1,800, amino acid position 1 to about amino acid 1,810, amino acid position 1 to about amino acid 1,820, amino acid position 1 to about amino acid 1,830, amino acid position 1 to about amino acid 1,840, amino acid position 1 to about amino acid 1,850, amino acid position 1 to about amino acid 1,860, amino acid position 1 to about amino acid 1,870, amino acid position 1 to about amino acid 1,880, amino acid position 1 to about amino acid 1,890, amino acid position 1 to about amino acid 1,900, amino acid position 1 to about amino acid 1,910, amino acid position 1 to about amino acid 1,920, amino acid position 1 to about amino acid 1,930, amino acid position 1 to about amino acid 1,940, amino acid position 1 to about amino acid 1,950, amino acid position 1 to about amino acid 1,960, amino acid position 1 to about amino acid 1,970, amino acid position 1 to about amino acid 1,980 of a wildtype otoferlin protein (e.g., SEQ ID NO: 5).

In some examples, the composition includes two vectors, where a first of the two vectors includes a coding sequence that is at least 80%, at least 82%, at least 84%, at least 86%, at least 88%, at least 90%, at least 92%, at least 94%, at least 96%, at least 98%, at least 99%, or 100% identical to SEQ ID NO: 62, and the second of the two vectors includes a coding sequence that is at least 80%, at least 82%, at least 84%, at least 86%, at least 88%, at least 90%, at least 92%, at least 94%, at least 96%, at least 98%, at least 99%, or 100% identical to SEQ ID NO: 63.

As used herein, the term "vector" includes any genetic element, such as a plasmid, phage, transposon, cosmid, chromosome, artificial chromosome, virus, virion, etc., that is capable of replication when associated with the proper control elements and that can transfer gene sequences between cells. Thus, the term includes cloning and expression vehicles, as well as viral vectors. In some embodiments, useful vectors are contemplated to be those vectors in which the nucleic acid segment to be transcribed is positioned under the transcriptional control of a promoter.

In some examples, a vector can be an artificial chromosome (e.g., a human artificial chromosome (HAC), a yeast artificial chromosome (YAC), a bacterial artificial chromosome (BAC), or a P1-derived artificial chromosome (PAC)) or a viral vector (e.g., any adenoviral vectors (e.g., pSV or pCMV vectors), any retroviral vectors as described herein, and any Gateway® vectors). A vector can, e.g., include sufficient cis-acting elements for expression; other elements for expression can be supplied by the host mammalian cell or in an in vitro expression system.

A "promoter" refers to a DNA sequence recognized by the synthetic machinery of the cell, or introduced synthetic machinery, required to initiate the specific transcription of a polynucleotide sequence (e.g., a gene). The phrases "operatively positioned," "under control" or "under transcriptional control" means that the promoter is in the correct location and orientation in relation to the nucleic acid to control RNA polymerase initiation and expression of the gene. The term "expression vector or construct" means any type of genetic construct containing a nucleic acid in which part or all of the nucleic acid coding sequence is capable of being transcribed. In some embodiments, expression includes transcription of the nucleic acid, for example, to generate a biologically-active polypeptide product or inhibitory RNA (e.g., shRNA, miRNA, miRNA inhibitor) from a transcribed gene.

Vectors include all those known in the art, including cosmids, plasmids (e.g., naked or contained in liposomes) and viruses (e.g., lentiviruses, retroviruses, adenoviruses, and adeno-associated viruses) that incorporate the recombinant polynucleotide. Skilled practitioners will be capable of selecting suitable vectors and mammalian cells for making any of the nucleic acids described herein.

In some embodiments the vector is a plasmid (i.e. a circular DNA molecule that can autonomously replicate inside a cell). In some embodiments, the vector can be a cosmid (e.g., pWE and sCos series (Wahl et al. (1987) Proc. Natl. Acad. Sci. USA 84:2160-2164, Evans et al. (1989) Proc. Natl. Acad. Sci. USA 86:5030-5034).

The term "transfer vector" refers to a composition of matter which includes an isolated nucleic acid and which can be used to deliver the isolated nucleic acid to the interior of a cell. Numerous vectors are known in the art including, but not limited to, linear polynucleotides, polynucleotides associated with ionic or amphiphilic compounds, plasmids, and viruses. Thus, the term "transfer vector" includes an autonomously replicating plasmid or a virus. The term should also be construed to further include non-plasmid and non-viral compounds which facilitate transfer of nucleic acid into cells, such as, for example, a polylysine compound, liposome, and the like. Examples of viral transfer vectors include, but are not limited to, adenoviral vectors, adeno-associated virus vectors, retroviral vectors, lentiviral vectors, and the like.

The term "expression vector" refers to a vector including a recombinant polynucleotide including expression control sequences operatively linked to a nucleotide sequence to be expressed. An expression vector includes sufficient cis-acting elements for expression; other elements for expression can be supplied by the host cell or in an in vitro expression system. Expression vectors include all those known in the art, including cosmids, plasmids (e.g., naked or contained in liposomes) and viruses (e.g., lentiviruses, retroviruses, adenoviruses, and adeno-associated viruses) that incorporate the recombinant polynucleotide.

In some embodiments, the vector(s) is an artificial chromosome. An artificial chromosome is a genetically engineered chromosome that can be used as a vector to carry large DNA inserts. In some embodiments, the artificial chromosome is human artificial chromosome (HAC) (see, e.g., Kouprina et al., *Expert Opin. DrugDeliv* 11(4): 517-535, 2014; Basu et al., *Pediatr. Clin. North Am.* 53: 843-853, 2006; Ren et al., *Stem. Cell Rev.* 2(1):43-50, 2006; Kazuki et al., *Mol. Ther.* 19(9):1591-1601, 2011; Kazuki et al., *Gen. Ther.* 18: 384-393, 2011; and Katoh et al., *Biochem. Biophys. Res. Commun.* 321:280-290, 2004).

In some embodiments, the vector(s) is a yeast artificial chromosome (YAC) (see, e.g., Murray et al., *Nature* 305: 189-193, 1983; Ikeno et al. (1998) *Nat. Biotech.* 16:431-439, 1998). In some embodiments, the vector(s) is a bacterial artificial chromosome (BAC) (e.g., pBeloBAC11, pEC-BAC1, and pBAC108L). In some embodiments, the vector(s) is a P1-derived artificial chromosome (PAC). Examples of artificial chromosome are known in the art.

In some embodiments, the vector(s) is a viral vector (e.g., adeno-associated virus, adenovirus, lentivirus, and retrovirus). Non-limiting examples of viral vectors are described herein.

Recombinant AAV Vectors

"Recombinant AAV vectors" or "rAAVs" of the disclosure are typically comprised of, at a minimum, a transgene or a portion thereof and a regulatory sequence, and optionally 5' and 3' AAV inverted terminal repeats (ITRs). It is this recombinant AAV vector which is packaged into a capsid protein and delivered to a selected target cell. In some embodiments, the transgene is a nucleic acid sequence, heterologous to the vector sequences, which encodes a polypeptide, protein, functional RNA molecule (e.g., miRNA, miRNA inhibitor) or other gene product, of interest. The nucleic acid coding sequence is operatively linked to regulatory components in a manner which permits transgene transcription, translation, and/or expression in a cell of a target tissue.

In some embodiments, the vector(s) is an adeno-associated viral vector (AAV) (see, e.g., Asokan et al., *Mol. Ther.* 20: 699-7080, 2012). "Recombinant AAV vectors" or "rAAVs" are typically composed of, at a minimum, a transgene or a portion thereof and a regulatory sequence, and optionally 5' and 3' AAV inverted terminal repeats (ITRs). Such a recombinant AAV vector is packaged into a capsid to form an rAAV particle and delivered to a selected target cell (e.g., an inner hair cell).

ITRs

The AAV sequences of the vector typically comprise the cis-acting 5' and 3' inverted terminal repeat sequences (See, e.g., B. J. Carter, in "Handbook of Parvoviruses", ed., P. Tijsser, CRC Press, pp. 155 168 (1990)). The ITR sequences are about 145 nt in length. Preferably, substantially the entire sequences encoding the ITRs are used in the molecule, although some degree of minor modification of these sequences is permissible. The ability to modify these ITR sequences is within the skill of the art. (See, e.g., texts such as Sambrook et al. "Molecular Cloning. A Laboratory Manual", 2d ed., Cold Spring Harbor Laboratory, New York (1989); and K. Fisher et al., J Virol., 70:520 532 (1996)). An example of such a molecule employed in the present disclosure is a "cis-acting" plasmid containing the transgene, in which the selected transgene sequence and associated regulatory elements are flanked by the 5' and 3' AAV ITR sequences. The AAV ITR sequences may be obtained from any known AAV, including presently identified mammalian AAV types. In some embodiments, an ITR is or comprises 145 nucleotides. In some embodiments an ITR is a wild-type AAV2 ITR, e.g., the 5' ITR of SEQ ID NO: 97 and the 3' ITR of SEQ ID NO: 104. In some embodiments an ITR is derived from a wild-type AAV2 ITR and includes one or more modifications, e.g., truncations, deletions, substitutions or insertions as is known in the art. In some embodiments, an ITR comprises fewer than 145 nucleotides, e.g., 127, 130, 134 or 141 nucleotides. For example, in some embodiments, an ITR comprises 110, 111, 112, 113, 114, 115, 116, 117, 118, 119, 120, 121, 122, 123, 124, 125, 126, 127, 128, 129, 130, 131, 132, 133, 134, 135, 136, 137, 138, 139, 140, 141, 142, 143, 144, or 145 nucleotides.

A non-limiting example of a 5' AAV ITR sequence is SEQ ID NO: 59. A non-limiting example of a 3' AAV ITR sequence is SEQ ID NO: 60. In some embodiments, vectors and/or constructs of the present disclosure comprise a 5' AAV ITR and/or a 3' AAV ITR. In some embodiments, a 5' AAV ITR sequence is SEQ ID NO: 97. In some embodiments, a 3' AAV ITR sequence is SEQ ID NO: 104. In some embodiments, the 5' AAV ITR sequence is SEQ ID NO: 97 and the 3' AAV ITR sequence is SEQ ID NO: 104. In some embodiments, the 5' and a 3' AAV ITRs (e.g., SEQ ID NOs: 97 and 104) flank a portion of a transgene and/or construct comprising a portion of OTOF (e.g., SEQ ID NO: 101 or 107).

Other Elements

In addition to the major elements identified above for the recombinant AAV vector, the vector also includes conventional control elements that are operably linked to the transgene in a manner which permits its transcription, translation and/or expression in a cell transfected with the plasmid vector or infected with the virus produced by the disclosure. As used herein, "operably linked" sequences include both expression control sequences that are contiguous with the gene of interest and expression control sequences that act in trans or at a distance to control the gene of interest.

AAV vectors as described herein may include any of the regulatory elements described herein (e.g., one or more of a promoter, a polyA sequence, and an IRES).

Capsids

In some embodiments, one or more recombinant AAV vectors of the present disclosure is packaged into a capsid of the AAV2, 3, 4, 5, 6, 7, 8, 9, 10, rh8, rh10, rh39, rh43 or Anc80 serotype or one or more hybrids thereof. In some embodiments, a capsid is from an ancestral serotype. For example, in some embodiments, the capsid is an Anc80 capsid (e.g., an Anc80L65 capsid). In some embodiments, the capsid comprises a polypeptide represented by SEQ ID NO: 109. In some embodiments, the capsid comprises a polypeptide with at least 85%, 90%, 95%, 98% or 99% sequence identity to the polypeptide represented by SEQ ID NO: 109.

Any combination of ITRs and capsids may be used in recombinant AAV vectors of the present disclosure, for example, wild-type or variant AAV2 ITRs and Anc80 capsid, wild-type or variant AAV2 ITRs and AAV6 capsid, etc. In some embodiments of the present disclosure an rAAV particle is an rAAV2/Anc80 particle which comprises an Anc80 capsid (e.g., comprising a polypeptide of SEQ ID NO: 109) that encapsidates a nucleic acid vector with wild-type AAV2 ITRs (e.g., SEQ ID NOs: 97 and 104) flanking a portion of a transgene and/or construct comprising a portion of OTOF (e.g., SEQ ID NO: 101 or 107).

Recombinant AV and Lentiviral Vectors

Also provided are therapeutic compositions including one or more adenoviral (AV) vectors, wherein the one or the plurality of AV vectors are capable of constituting an auditory polypeptide messenger RNA in a target cell of a human subject to whom the therapeutic composition is administered. Preferably, the one or the plurality of AV vectors are capable of constituting a full-length auditory polypeptide messenger RNA in a target cell of a human subject to whom the therapeutic composition is administered.

In some embodiments, the vector(s) is an adenovirus (see, e.g., Dmitriev et al. (1998) J. Virol. 72: 9706-9713; and Poulin et al., J. Virol 8: 10074-10086, 2010). In some embodiments, the vector(s) is a retrovirus (see, e.g., Maier et al. (2010) Future Microbiol 5: 1507-23).

In some embodiments, the vector(s) is a lentivirus (see, e.g., Matrai et al. (2010) Mol Ther. 18: 477-490; Banasik et al. (2010) Gene Ther. 17:150-7; and Wanisch et al. (2009) Mol. Ther. 17: 1316-32). A lentiviral vector refers to a vector derived from at least a portion of a lentivirus genome, including especially a self-inactivating lentiviral vector as provided in Milone et al., Mol. Ther. 17(8): 1453-1464 (2009). Non-limiting lentivirus vectors that may be used in the clinic include the LENTIVECTOR® gene delivery technology from Oxford BioMedica, the LENTIMAX™ vector system from Lentigen, and the like. Other types of lentiviral vectors are also available and would be known to one skilled in the art.

The term "lentivirus" refers to a genus of the Retroviridae family. Lentiviruses are unique among the retroviruses in being able to infect non-dividing cells; they can deliver a significant amount of genetic information into the DNA of the host cell, so they are one of the most efficient methods of a gene delivery vector. HIV, SIV, and FIV are all examples of lentiviruses.

The term "lentiviral vector" refers to a vector derived from at least a portion of a lentivirus genome, including especially a self-inactivating lentiviral vector as provided in Milone et al., Mol. Ther. 17(8): 1453-1464 (2009). Other examples of lentivirus vectors that may be used in the clinic include but are not limited to, e.g., the LENTIVECTOR®. gene delivery technology from Oxford BioMedica, the LENTIMAX™ vector system from Lentigen and the like. Nonclinical types of lentiviral vectors are also available and would be known to one skilled in the art.

For example, provided are therapeutic compositions including one or a plurality of lentiviral vectors, wherein the one or the plurality of lentiviral vectors are capable of constituting an auditory polypeptide messenger RNA in a target cell of a human subject to whom the therapeutic composition is administered. In one embodiment, the one or the plurality of lentiviral vectors are capable of constituting a full-length auditory polypeptide messenger RNA in a target cell of a human subject to whom the therapeutic composition is administered.

In some embodiments of any of the compositions described herein, the first vector includes an ITR (e.g., any of the exemplary ITR sequences described herein), a promoter and/or enhancer (e.g., any of the exemplary enhancers and any of the exemplary promoters described herein), an intron sequence of a OTOF gene (e.g., a human OTOF gene, e.g., any of the exemplary intron sequences of a human OTOF gene described herein), a Kozak sequence (e.g., any of the exemplary Kozak sequences described herein), and a sequence encoding a first, N-terminal portion of a human otoferlin protein (e.g., any of the exemplary sequences encoding a first, N-terminal portion of a human otoferlin protein described herein), an AK sequence (e.g., any of the exemplary AK sequences described herein), and an ITR (e.g., any of the exemplary ITR sequences described herein). In some embodiments of any of the compositions described herein, the second vector includes an ITR sequence (e.g., any of the exemplary ITR sequences described herein), an AK sequence (e.g., any of the exemplary AK sequences described herein), a splicing acceptor sequence (e.g., any of the splicing acceptor sequences described herein), a sequence encoding a second portion of a human otoferlin protein (e.g., any of the exemplary sequences encoding a second, C-terminal portion of a human otoferlin protein described herein), a poly(A) signal sequence (e.g., any of the exemplary poly(A) signal sequences described herein), a stuffer sequence (e.g., any of the exemplary stuffer sequences described herein), and an ITR sequence (e.g., any of the exemplary ITR sequences described herein).

Figure 11:
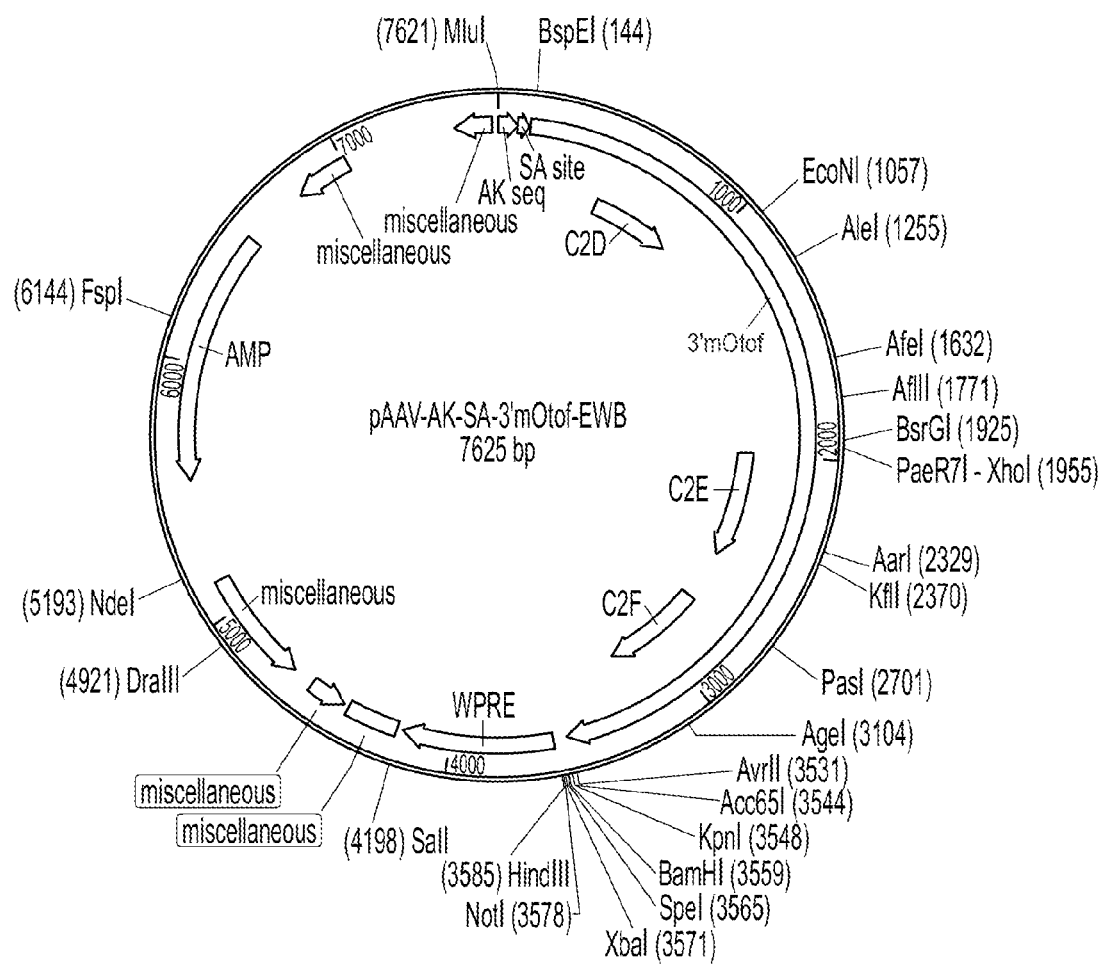
FIG. 11 is a representative plasmid map of pAAV-AK-SA-3'mOTOF-EWB.
Figure 17:
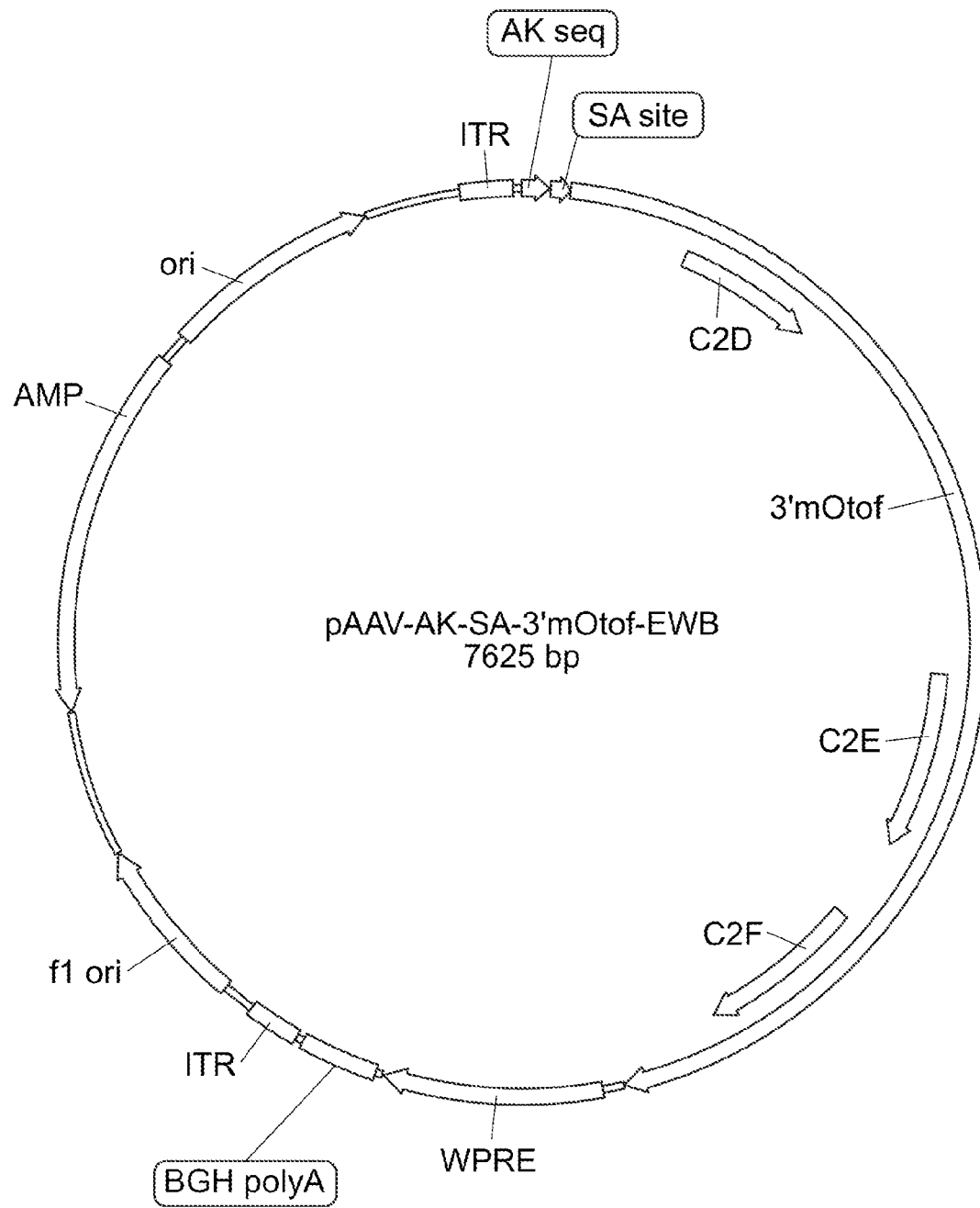
FIG. 17 is a representative plasmid map of pAAV-AK-SA-3'mOTOF-EWB.
Figure 56:
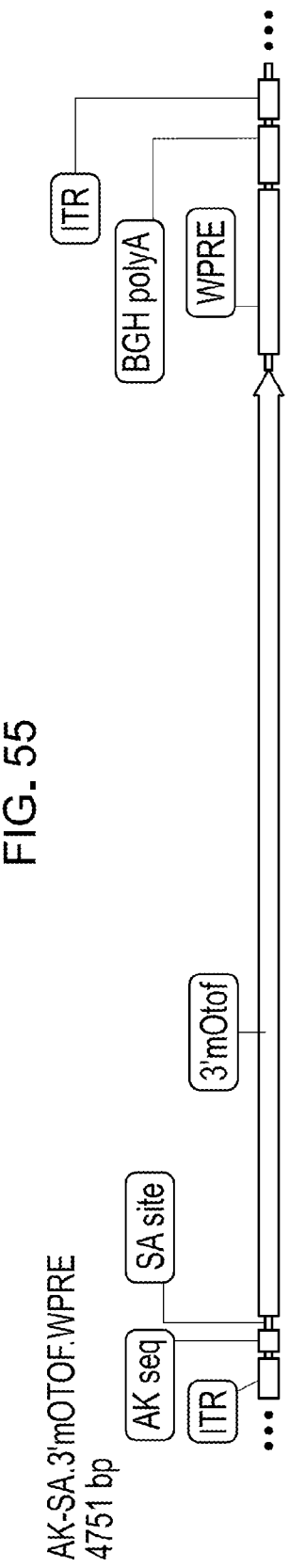
FIG. 56 is a representative schematic of a portion of pAAV-AK-SA-3'mOTOF.WPRE.

In some embodiments of any of the compositions described herein, the vector is pAAV-AK-SA-3'mOTOF-EWB (SEQ ID NO: 39), depicted in FIGS. 11, 17 and 56, or is a vector including a sequence that is at least 80%, at least 82%, at least 84%, at least 86%, at least 88%, at least 90%, at least 92%, at least 94%, at least 96%, at least 98%, at least 99%, or 100% identical to SEQ ID NO: 39. The pAAV-AK-SA-3'mOTOF-EWB vector is 7625 bp in length and has an AK sequence at nucleotide positions 2-78, a splicing acceptor (SA) site at nucleotide positions 79-129, a 3' mOTOF at nucleotide positions 130-3540, C2D at nucleotide positions 490-891, C2E at nucleotide positions 1996-2516, C2F at nucleotide positions 2749-3234, a WPRE at nucleotide positions 3595-4188, an ampicillin (AMP) resistance gene at nucleotide positions 5537-6537, a bovine growth hormone poly A-tail (bGH pA) at nucleotide positions 4212-4422, a phage-derived fl(+) origin of replication (ORI) at nucleotide positions 4674-5133, an origin of replication (ORI) at nucleotide positions 6787-7012.

Figure 12:
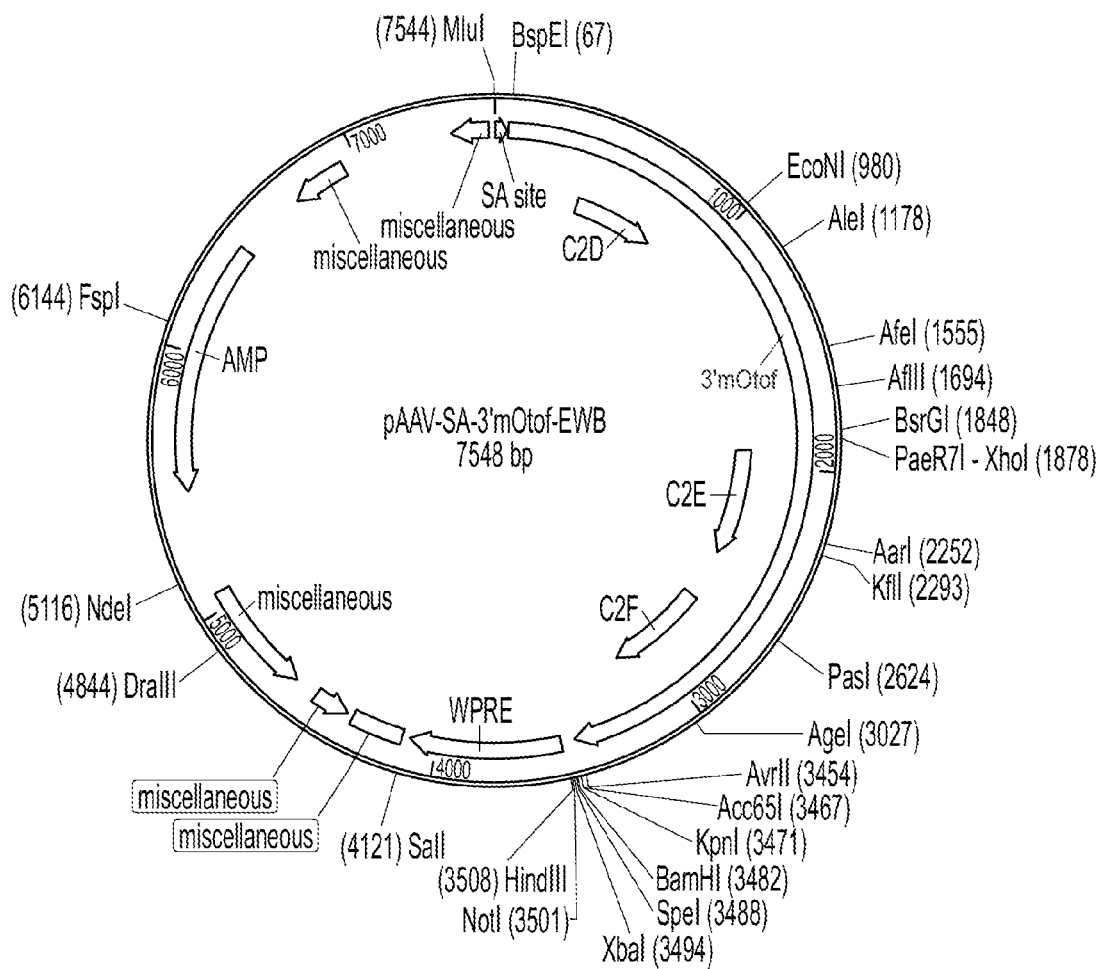
FIG. 12 is a representative plasmid map of pAAV-SA-3'mOTOF-EWB.
Figure 20:
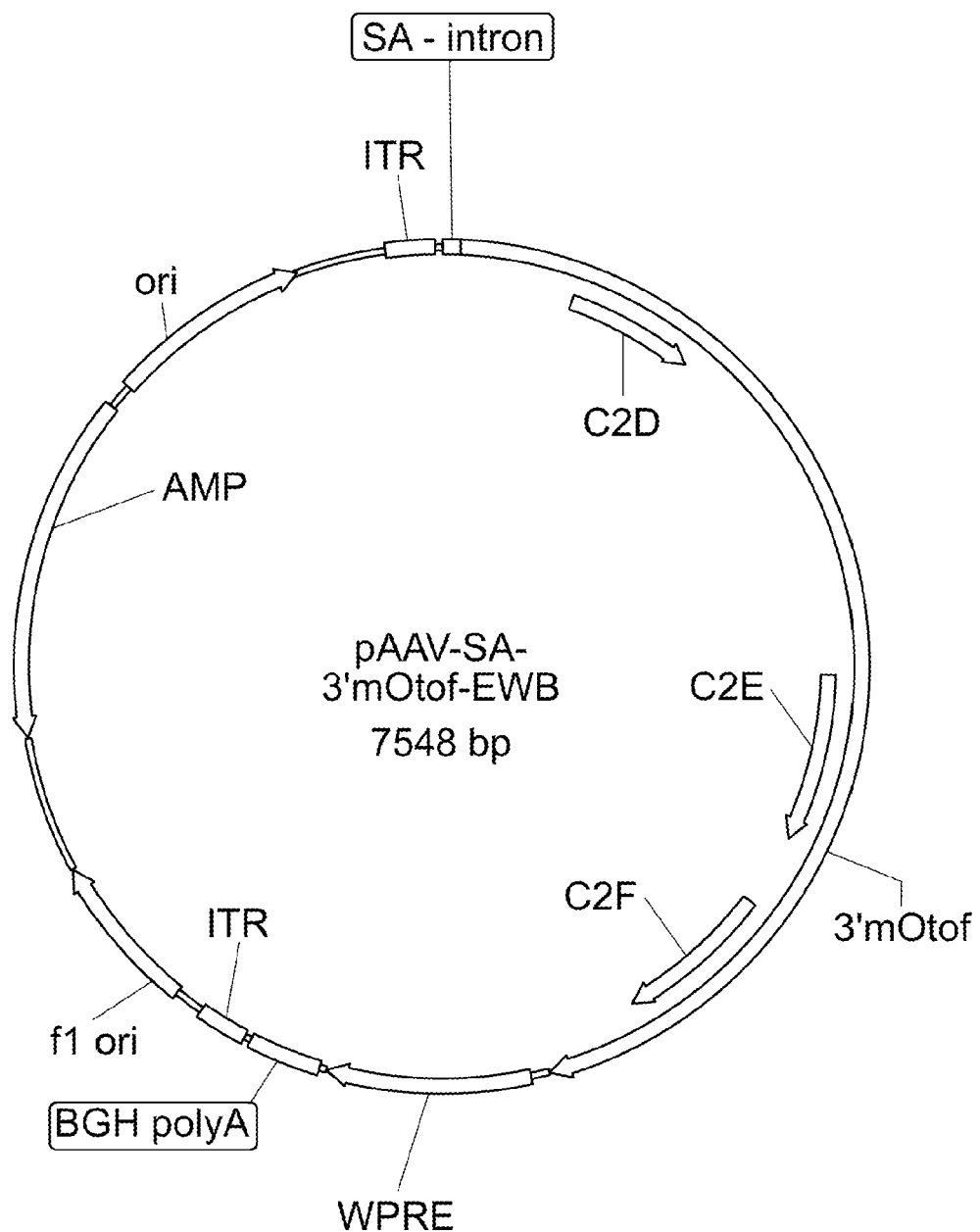
FIG. 20 is a representative plasmid map of pAAV-SA-3'mOTOF-EWB.
Figure 54:
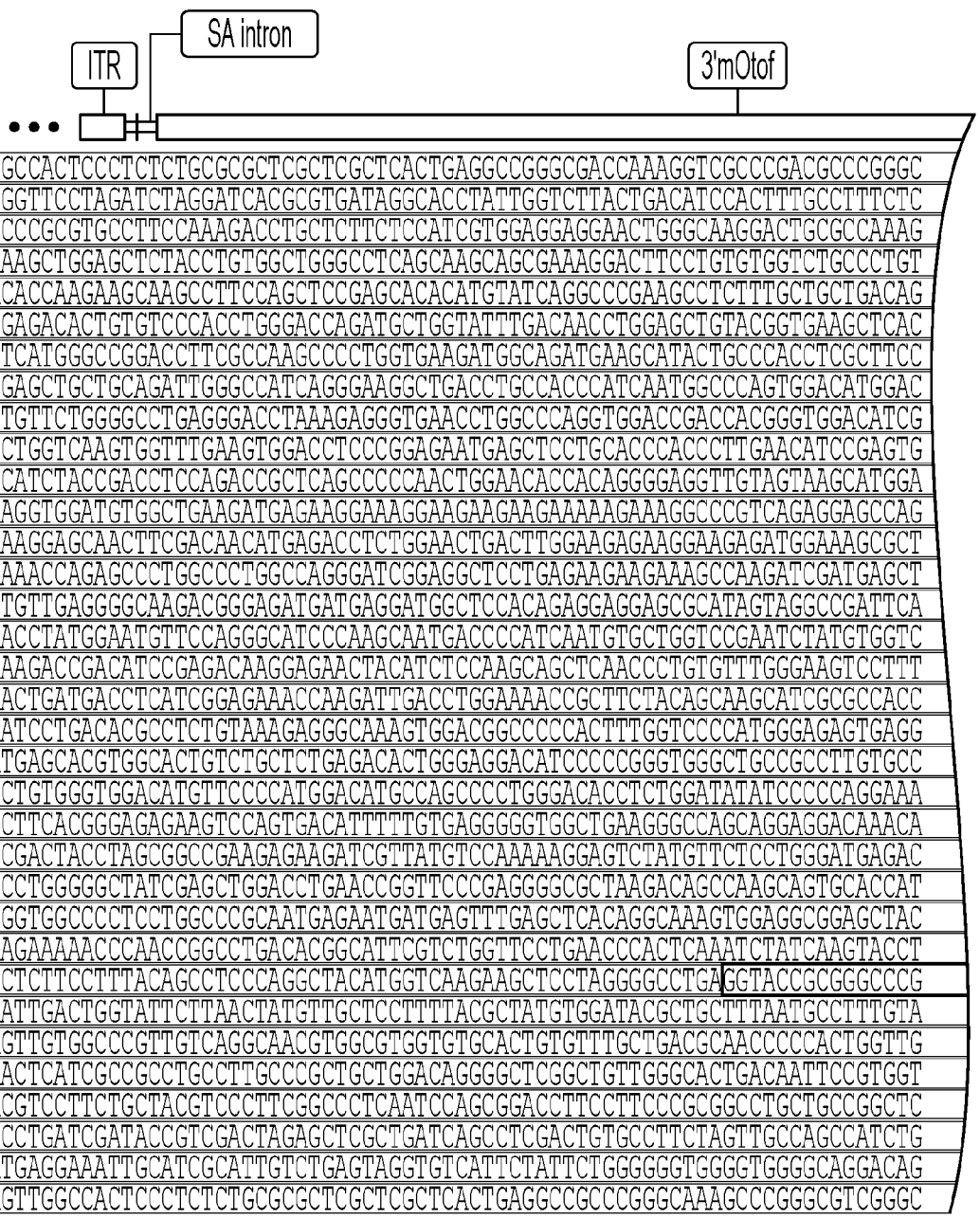
FIG. 54 is a representative schematic of a portion of pAAV-SA-3'mOTOF.WPRE (SEQ ID NO: 88).
Figure 54:
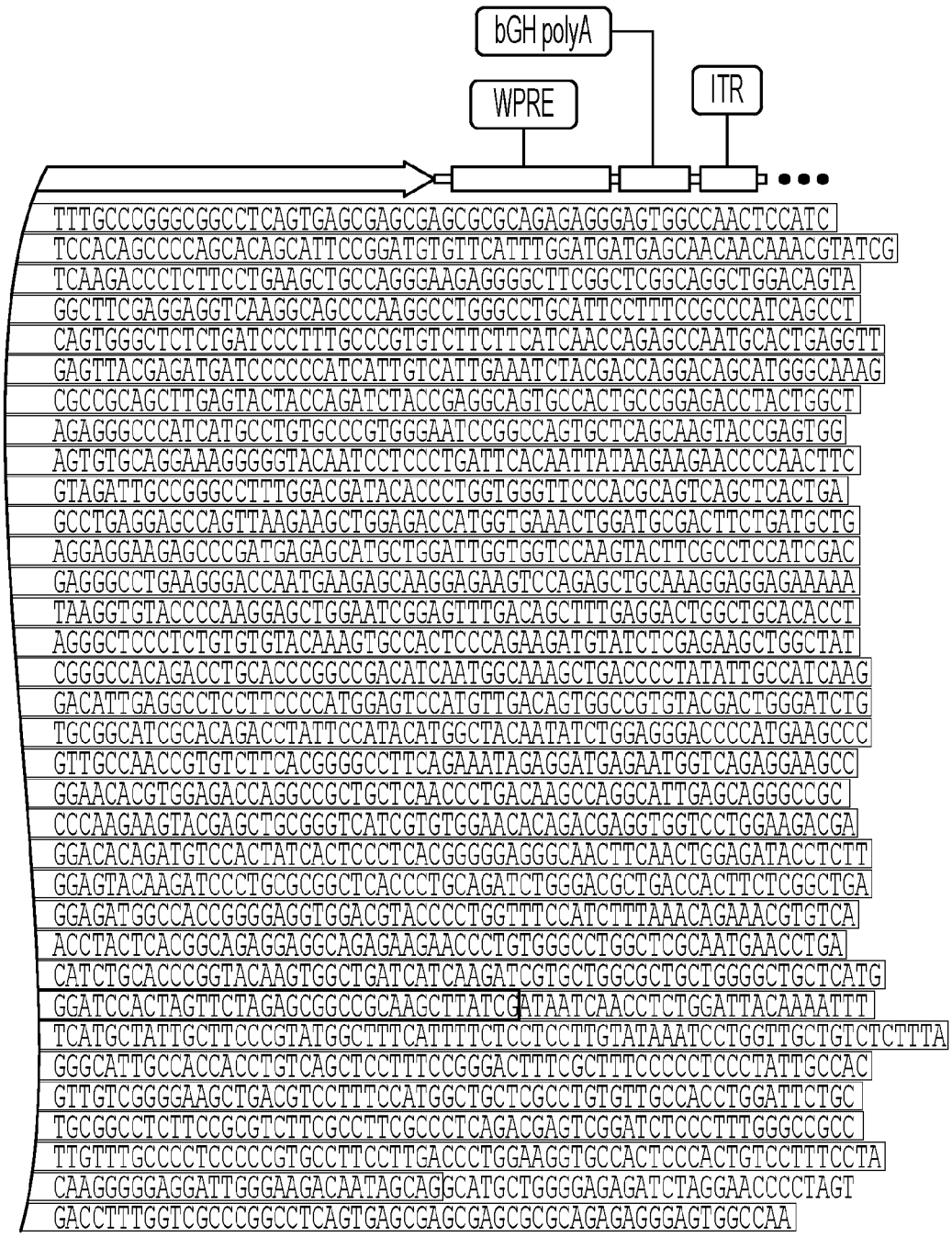

In some embodiments of any of the compositions described herein, the vector is pAAV-SA-3'mOTOF-EWB (SEQ ID NO: 40), depicted in FIGS. 12, 20 and 54, or is a vector that is at least 80%, at least 82%, at least 84%, at least 86%, at least 88%, at least 90%, at least 92%, at least 94%, at least 96%, at least 98%, at least 99%, or 100% identical to SEQ ID NO: 40. The pAAV-SA-3'mOTOF-EWB vector is 7548 bp in length and has a splicing acceptor (SA) site at nucleotide positions 2-52, a 3' mOTOF at nucleotide positions 53-3463, C2D at nucleotide positions 413-814, C2E at nucleotide positions 1919-2439, C2F at nucleotide positions 2672-3157, a WPRE at nucleotide positions 3518-4111, an ampicillin (AMP) resistance gene at nucleotide positions 5460-6460, a bovine growth hormone poly A-tail (bGH pA) at nucleotide positions 4135-4345, and a phage-derived fl(+) origin of replication (ORI) at nucleotide positions 4597-5056.

Figure 13:
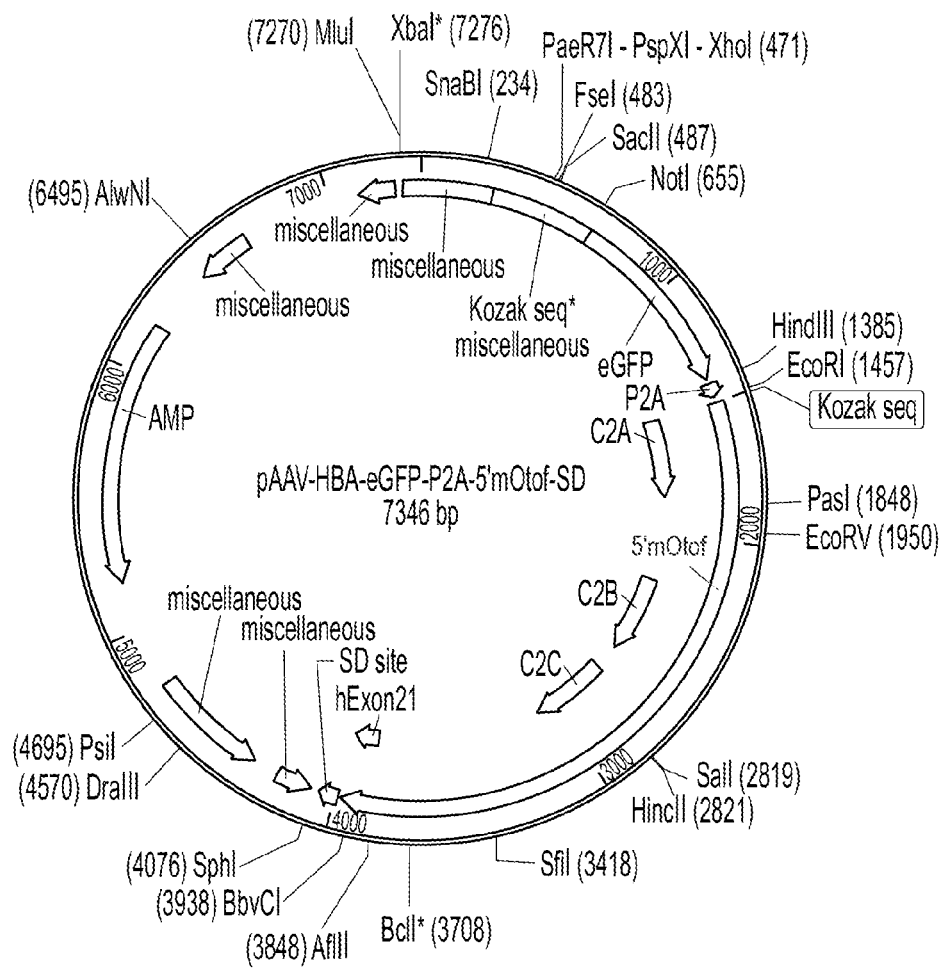
FIG. 13 is a representative plasmid map of pAAV-HBA-eGFP-P2A-5'mOTOF-SD.
Figure 18:
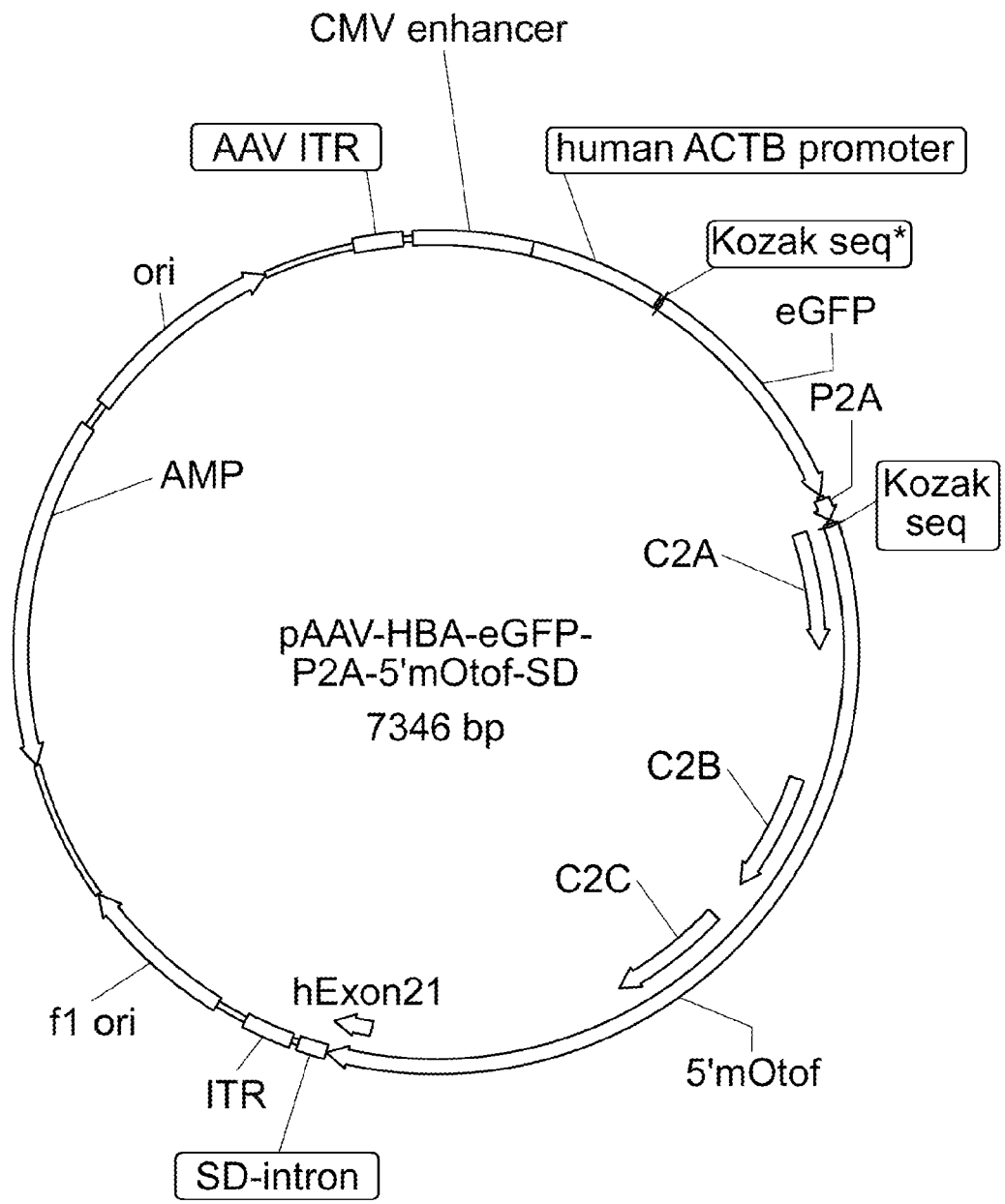
FIG. 18 is a representative plasmid map of pAAV-HBA-eGFP-P2A-5'mOTOF-SD.
Figure 53:
FIG. 53 is a representative schematic of a portion of pAAV-HBA-eGFP-P2A-5'mOTOF.SD (SEQ ID NO: 87).
Figure 53:

In some embodiments of any of the compositions described herein, the vector is pAAV-HBA-eGFP-P2A-5'mOTOF-SD (SEQ ID NO: 41), depicted in FIGS. 13, 18 and 53, or is a vector including a sequence that is at least 80%, at least 82%, at least 84%, at least 86%, at least 88%, at least 90%, at least 92%, at least 94%, at least 96%, at least 98%, at least 99%, or 100% identical to SEQ ID NO: 41. The pAAV-HBA-eGFP-P2A-5'mOTOF-SD vector is 7346 bp in length and has a Kozak sequence(*) at nucleotide positions 662-667, an enhanced green fluorescent protein (eGFP) sequence at nucleotide positions 668-1384, a P2A at nucleotide positions 1391-1456, a Kozak sequence at nucleotide positions 1463-1468, a 5' mOTOF sequence at nucleotide positions 1469-3988, a C2A at nucleotide positions 1469-1831, a C2B at nucleotide positions 2231-2599, a C2C at nucleotide positions 2720-3091, human OTOF exon 21 at nucleotide positions 3872-3988, a splicing donor (SD) site at nucleotide positions 3989-4070, an AMP resistance gene at nucleotide positions 5186-6186, a fl(+)ORI at nucleotide positions 4323-4782, an ORI at nucleotide positions 6436-6661, and a human cytomegalovirus (hCMV) enhancer at nucleotide positions 7277-272.

Figure 14:
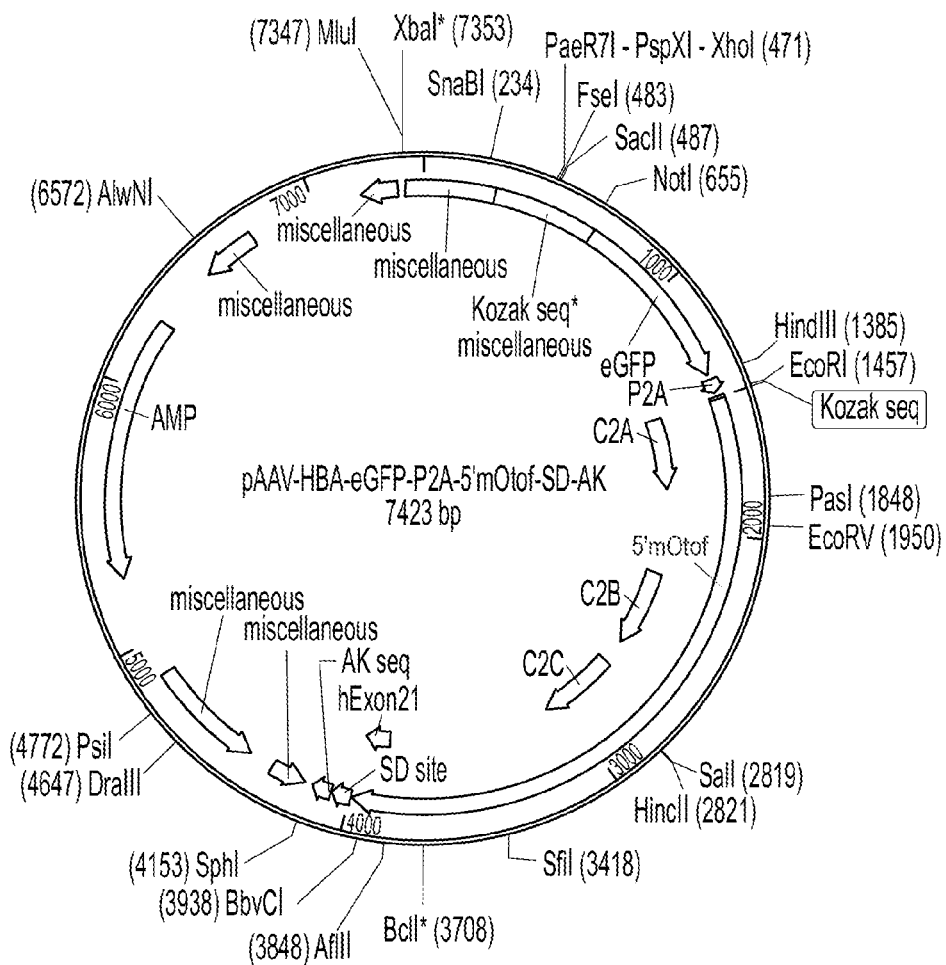
FIG. 14 is a representative plasmid map of pAAV-HBA-eGFP-P2A-5'mOTOF-SD-AK.
Figure 19:
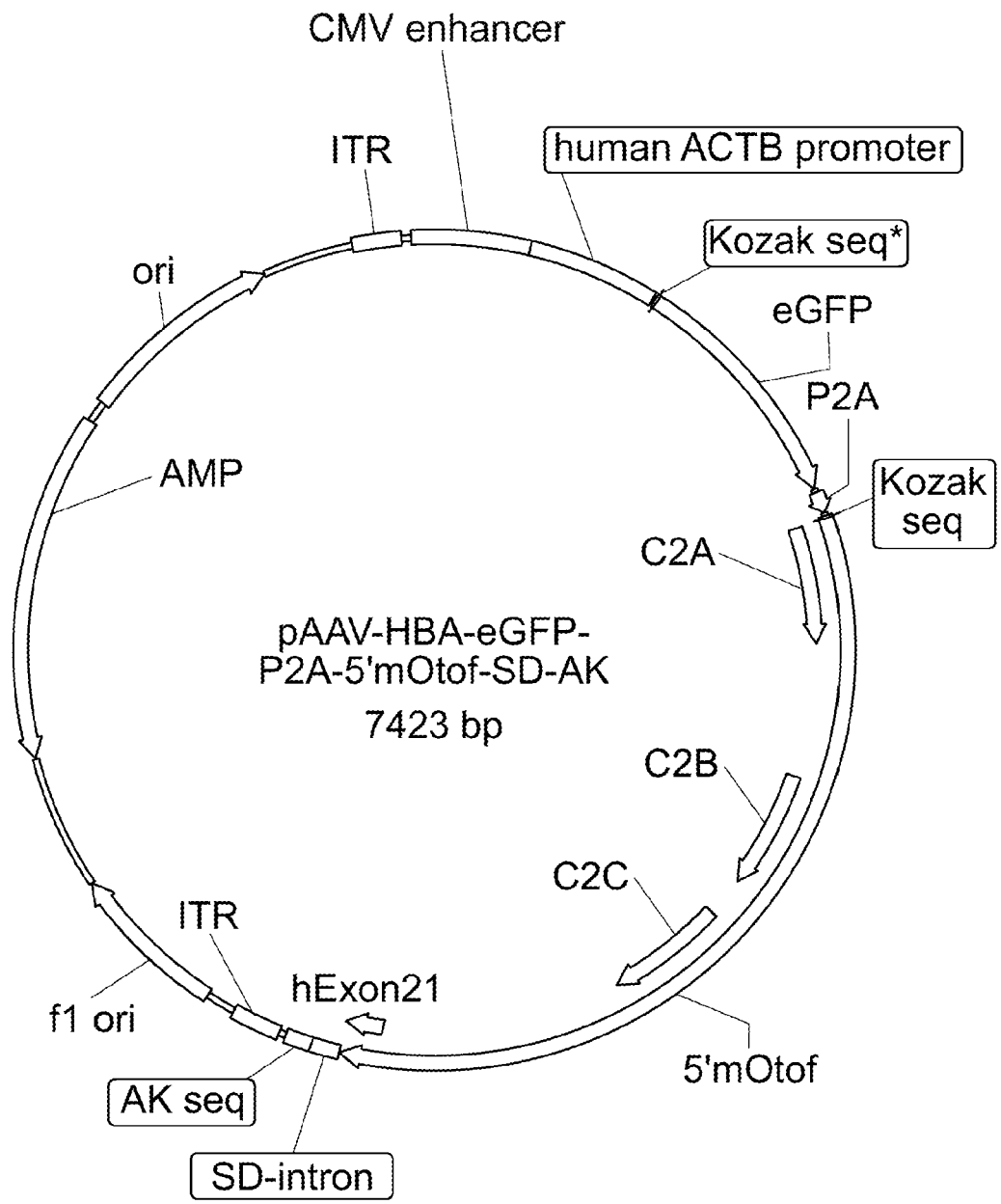
FIG. 19 is a representative plasmid map of pAAV-HBA-eGFP-P2A-5'mOTOF-SD-AK.
Figure 55:
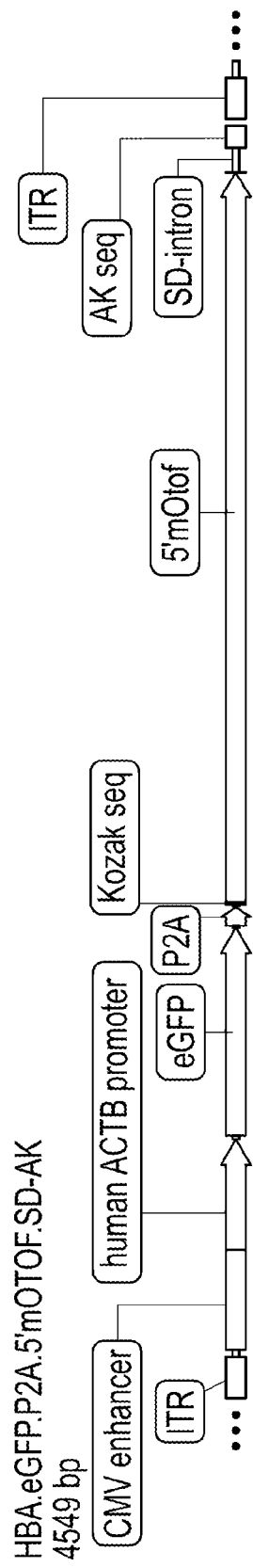
FIG. 55 is a representative schematic of a portion of pAAV-HBA-eGFP-P2A-5'mOTOF.SD-AK.

In some embodiments of any of the compositions described herein, the vector is pAAV-HBA-eGFP-P2A-5'mOTOF-SD-AK (SEQ ID NO: 42), depicted in FIGS. 14, 19 and 55, or is a vector including a sequence that is at least 80%, at least 82%, at least 84%, at least 86%, at least 88%, at least 90%, at least 92%, at least 94%, at least 96%, at least 98%, at least 99%, or 100% identical to SEQ ID NO: 42. The pAAV-HBA-eGFP-P2A-5'mOTOF-SD-AK is 7423 bp in length and has a Kozak sequence(*) at nucleotide positions 662-667, an enhanced green fluorescent protein (eGFP) sequence at nucleotide positions 668-1384, a P2A at nucleotide positions 1391-1456, a Kozak sequence at nucleotide positions 1463-1468, a 5' mOTOF sequence at nucleotide positions 1469-3988, a C2A at nucleotide positions 1469-1831, a C2B at nucleotide positions 2231-2599, a C2C at nucleotide positions 2720-3091, human OTOF exon 21 at nucleotide positions 3872-3988, a splicing donor (SD) site at nucleotide positions 3989-4070, an AK sequence at nucleotide positions 4071-4147, an AMP resistance gene at nucleotide positions 5263-6263, a fl(+)ORI at nucleotide positions 4400-4859, an ORI at nucleotide positions 6513-6738, and a human cytomegalovirus (hCMV) enhancer at nucleotide positions 7354-272.

Figure 21:
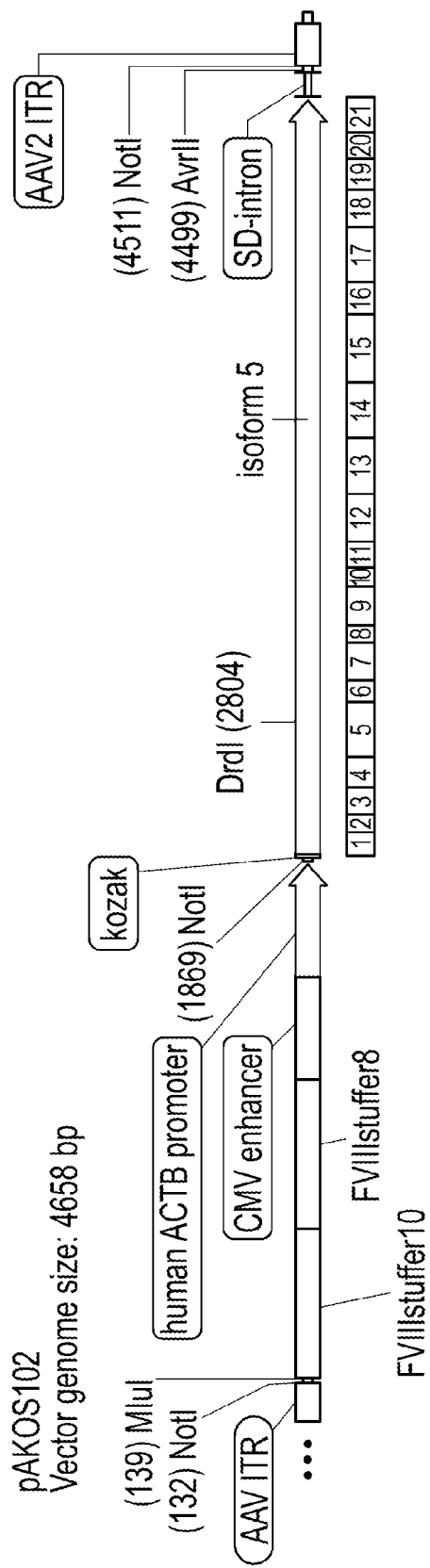
FIG. 21 is a representative schematic of a portion of pAKOS102 (SEQ ID NO: 43).
Figure 22:
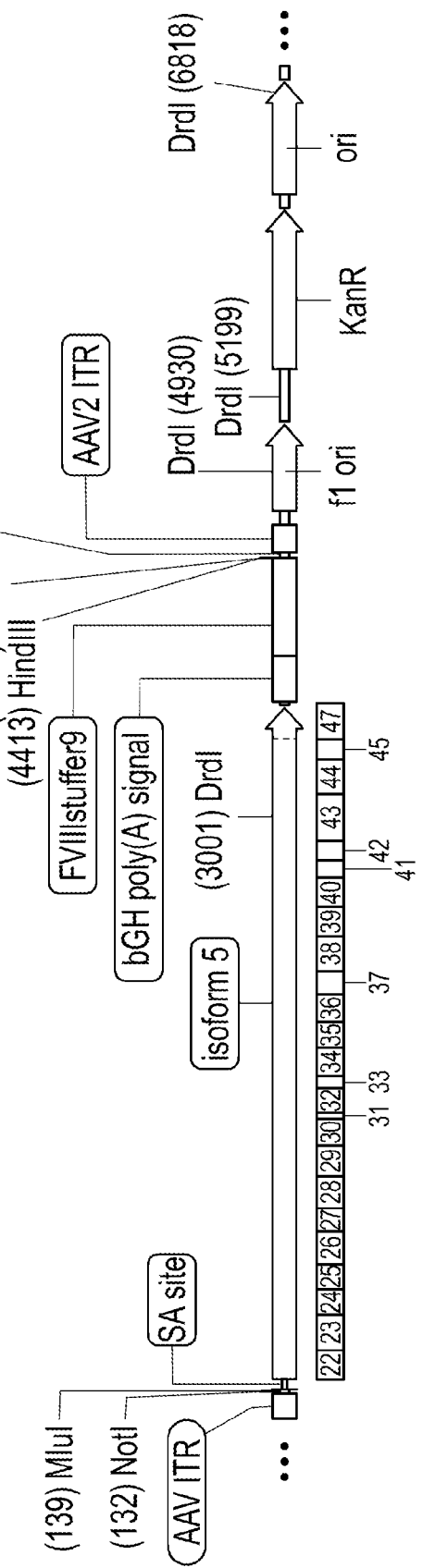
FIG. 22 is a representative schematic of a portion of pAKOS103 (SEQ ID NO: 44).
Figure 23:
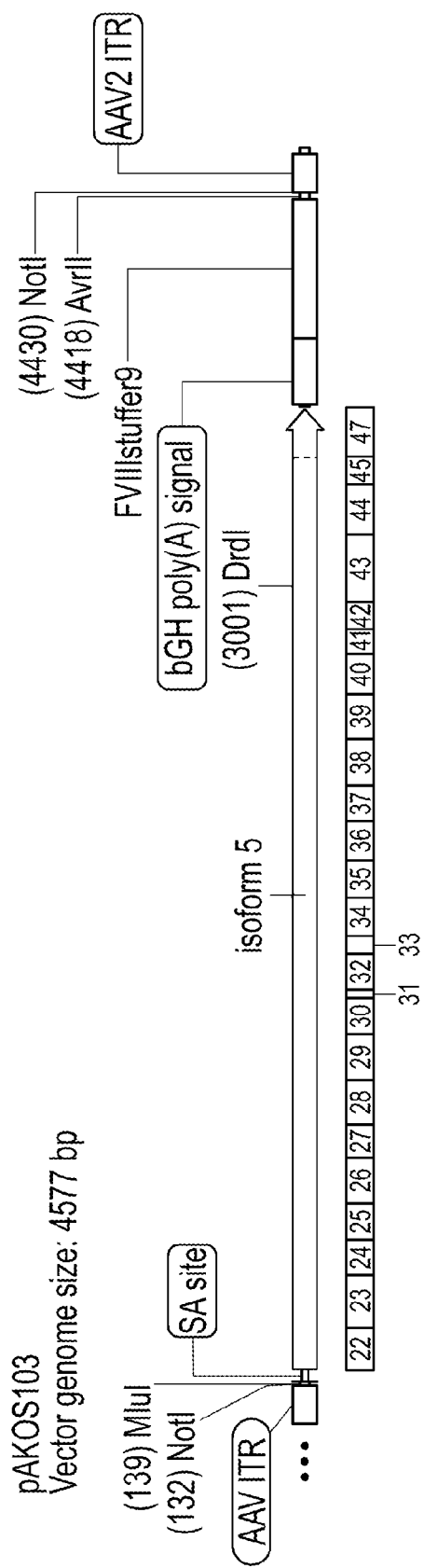
FIG. 23 is a representative schematic of a portion of pAKOS103.

In some embodiments of any of the compositions described herein, the vector is pAKOS102 (SEQ ID NO: 43), or is a vector including a sequence that is at least 80%, at least 82%, at least 84%, at least 86%, at least 88%, at least 90%, at least 92%, at least 94%, at least 96%, at least 98%, at least 99%, or 100% identical to SEQ ID NO: 43. pAKOS102 is shown in FIG. 21. The pAKOS102 vector is 7006 bp in length and has an AAV ITR sequence at nucleotide positions 1-130, a factor VIII stuffer sequence at nucleotide positions 145-1144, a human cytomegalovirus (hCMV) enhancer at nucleotide positions 1145-1486, a human ACTB promoter at nucleotide positions 1487-1869, a Kozak sequence at nucleotide positions 1883-1888, a 5' hOTOF isoform 5 sequence at nucleotide positions 1889-4411, a SD intron sequence at nucleotide positions 4412-4493, an AAV2 ITR sequence at nucleotide positions 4519-4659, a fl(+)ORI at nucleotide positions 4734-5189, an KAN resistance gene at nucleotide positions 5469-6278, and an ORI at nucleotide positions 6357-6945.

Figure 24:
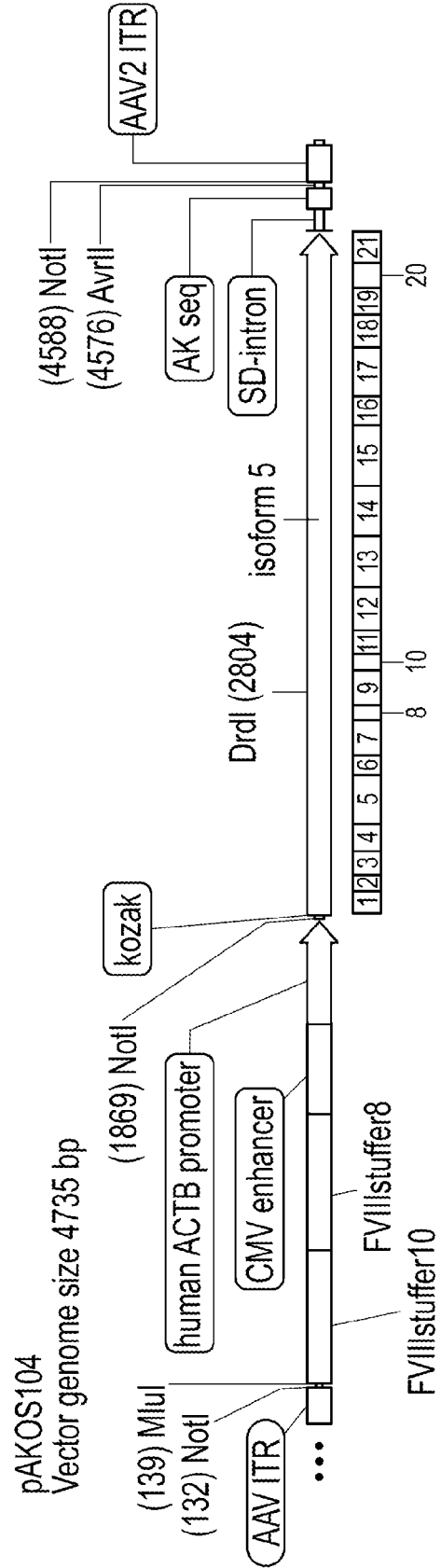
FIG. 24 is a representative plasmid map of pAKOS104 (SEQ ID NO: 45).
Figure 25:
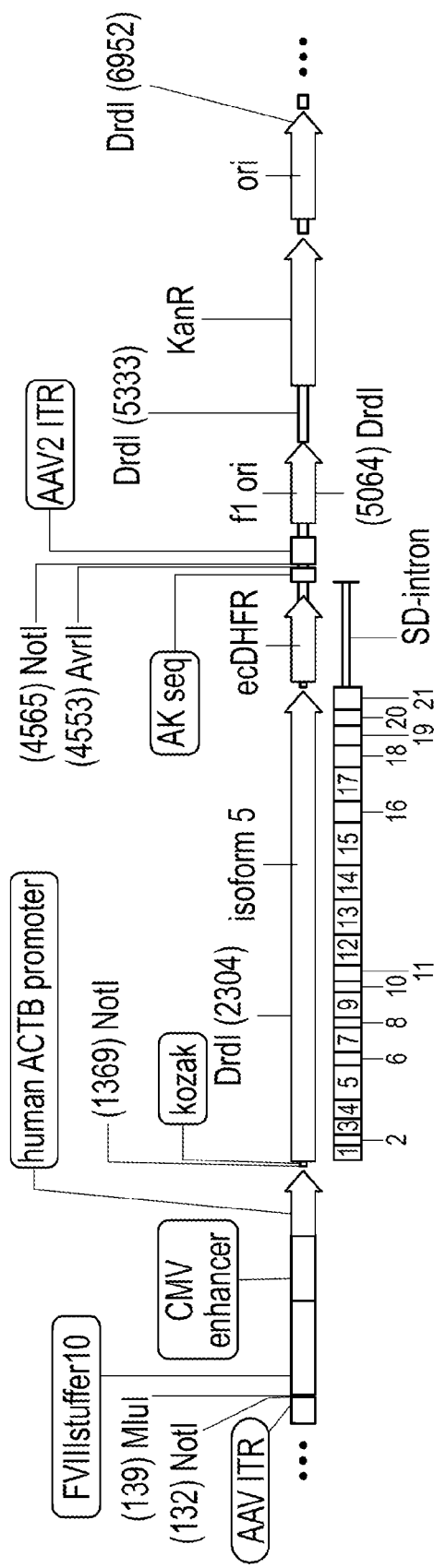
FIG. 25 is a representative schematic of a portion of pAKOS104-DHFR (SEQ ID NO: 46).
Figure 26:
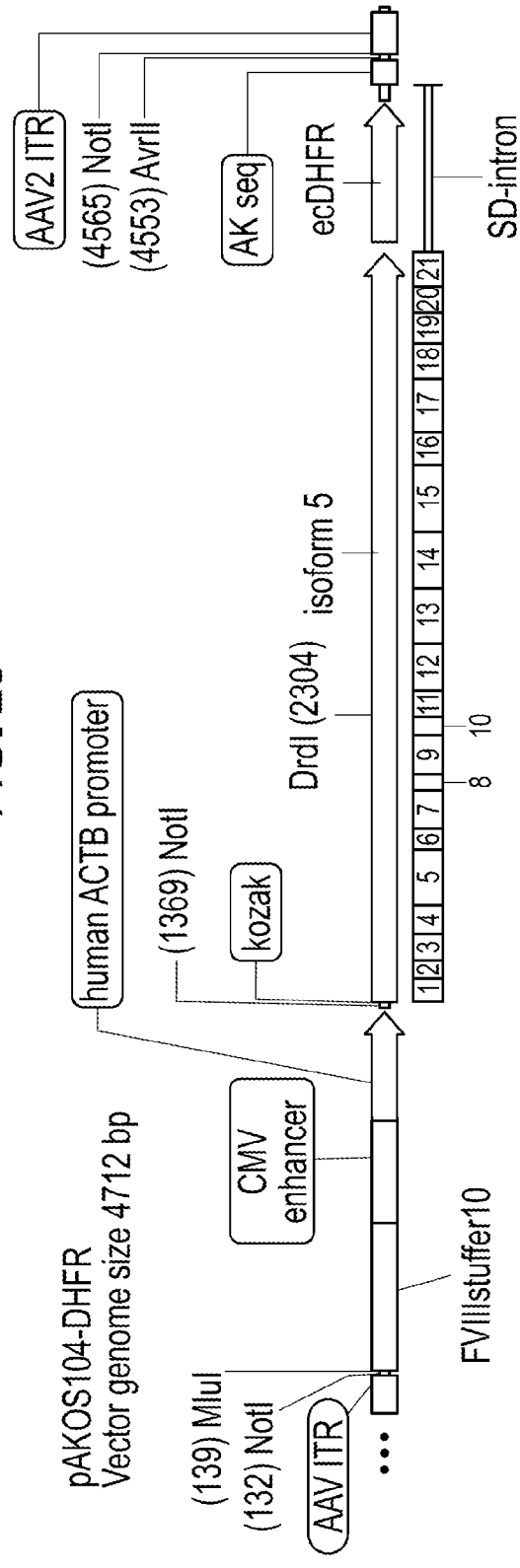
FIG. 26 is a representative schematic of a portion of pAKOS104-DHFR.
Figure 27:
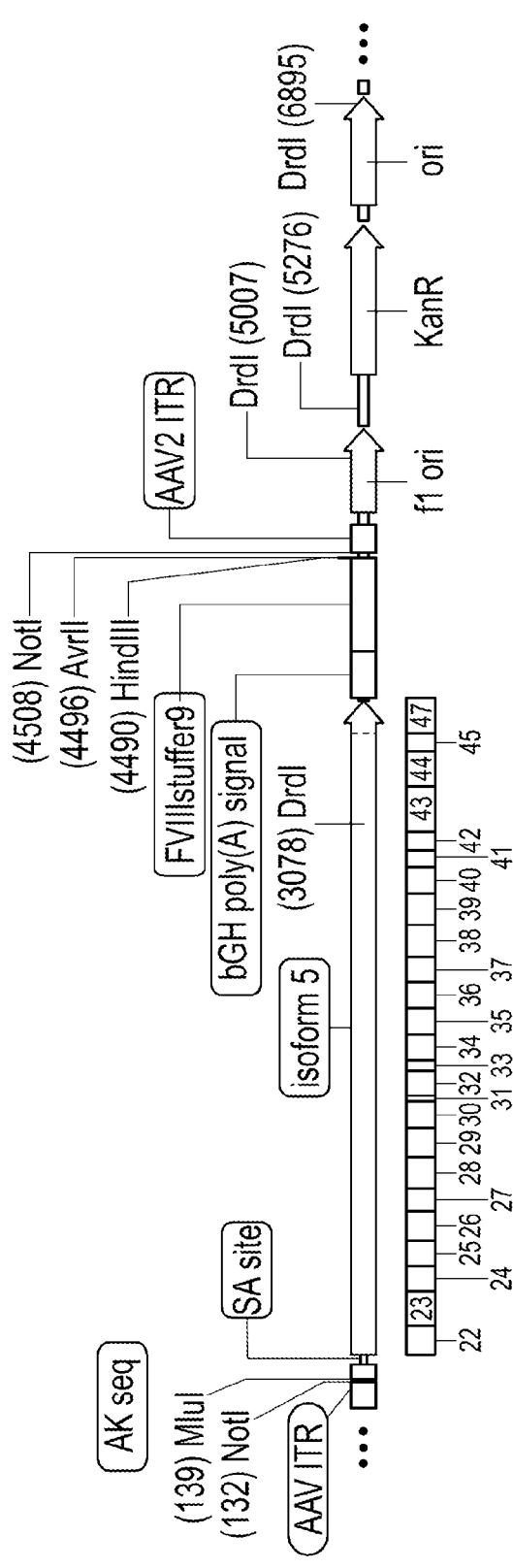
FIG. 27 is a representative schematic of a portion of pAKOS105 (SEQ ID NO: 47).

In some embodiments of any of the compositions described herein, the vector is pAKOS104 (SEQ ID NO: 45), or is a vector including a sequence that is at least 80%, at least 82%, at least 84%, at least 86%, at least 88%, at least 90%, at least 92%, at least 94%, at least 96%, at least 98%, at least 99%, or 100% identical to SEQ ID NO: 45. pAKOS104 is shown in FIG. 24. The pAKOS104 vector is 7083 bp in length and has an AAV ITR sequence at nucleotide positions 1-130, a factor VIII stuffer sequence at nucleotide positions 145-1144, a human cytomegalovirus (hCMV) enhancer at nucleotide positions 1145-1486, a human ACTB promoter at nucleotide positions 1487-1869, a Kozak sequence at nucleotide positions 1883-1888, a 5' hOTOF isoform 5 sequence at nucleotide positions 1889-4411, a SD intron sequence at nucleotide positions 4412-4493, an AK sequence at nucleotide positions 4494-4570, an AAV2 ITR sequence at nucleotide positions 4596-4736, a fl(+)ORI at nucleotide positions 4811-5266, an KAN resistance gene at nucleotide positions 5546-6355, and an ORI at nucleotide positions 6434-7022.

Figure 29:
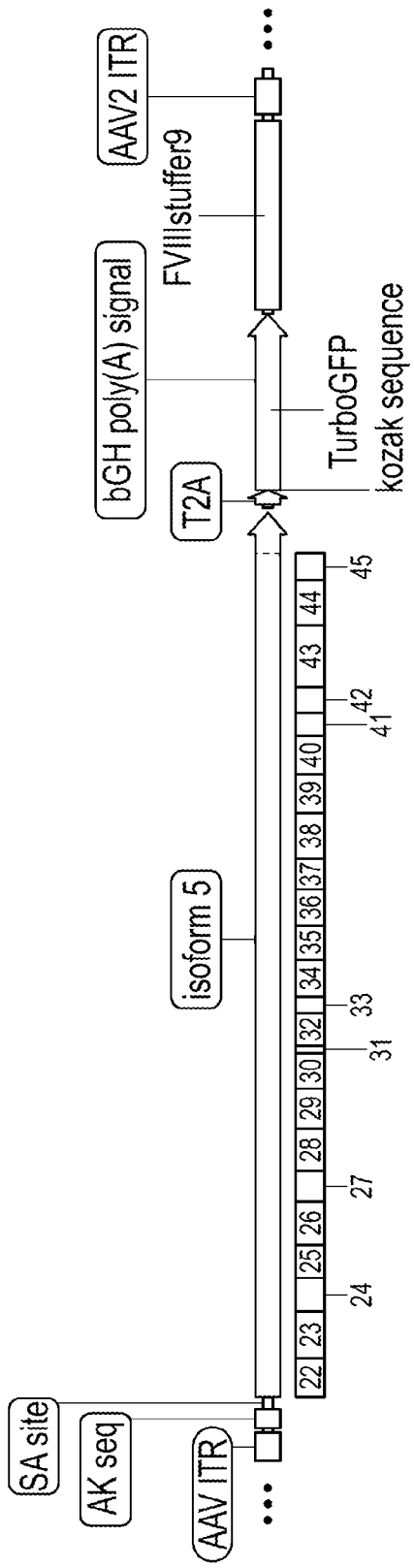
FIG. 29 is a representative schematic of a portion of pAKOS105_GFP (SEQ ID NO: 48).
Figure 30:
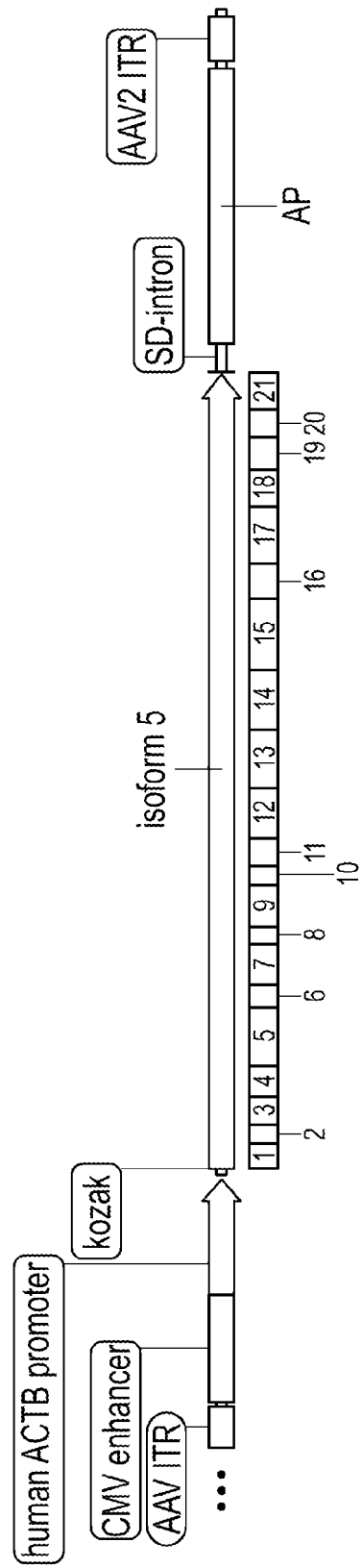
FIG. 30 is a representative schematic of a portion of pAKOS106 (SEQ ID NO: 49).
Figure 33:
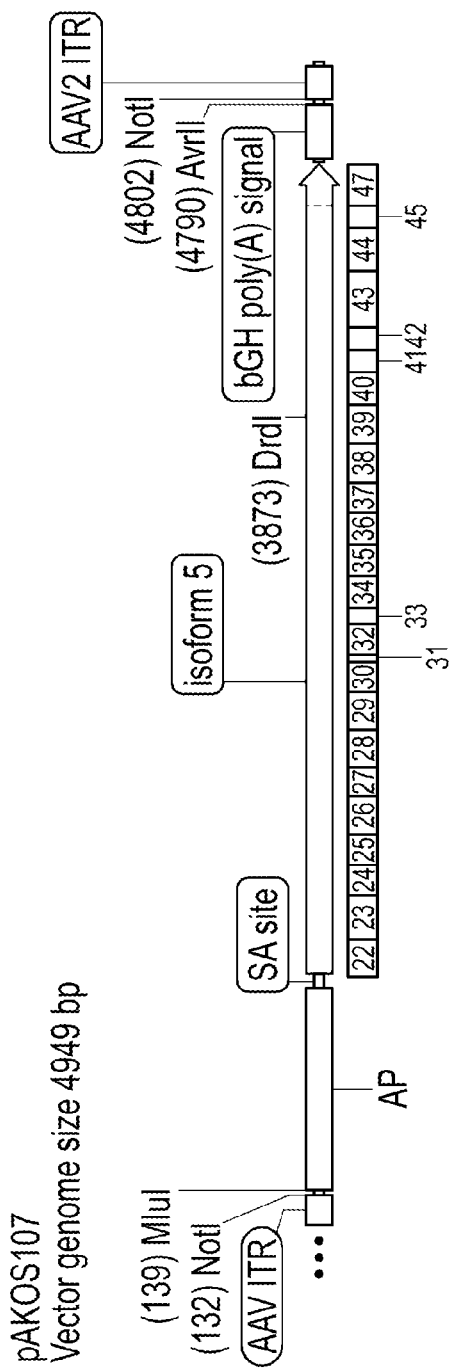
FIG. 33 is a representative schematic of a portion of pAKOS107.
Figure 34:
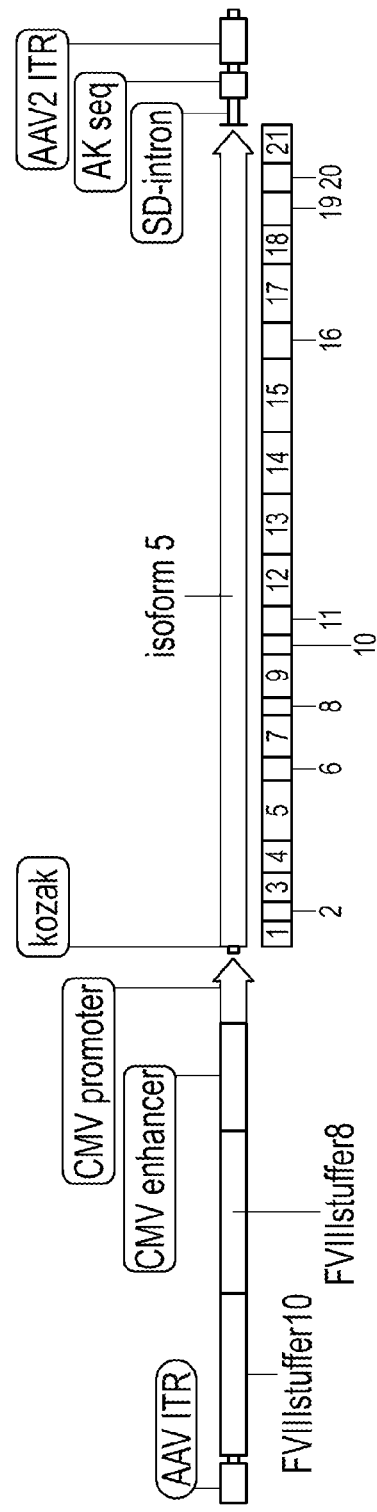
FIG. 34 is a representative schematic of a portion of pAKOS108 (SEQ ID NO: 51).

In some embodiments of any of the compositions described herein, the vector is pAKOS105_GFP (SEQ ID NO: 48), depicted in FIG. 29, or is a vector including a sequence that is at least 80%, at least 82%, at least 84%, at least 86%, at least 88%, at least 90%, at least 92%, at least 94%, at least 96%, at least 98%, at least 99%, or 100% identical to SEQ ID NO: 48. The pAKOS105_GFP vector is 7761 bp in length and has an AAV ITR sequence at nucleotide positions 1-130, an AK sequence at nucleotide positions 145-221, a SA site sequence at nucleotide positions 222-272, a 3' hOTOF isoform 5 sequence at nucleotide positions 273-3740, a T2A sequence at nucleotide positions 3750-3803, a turboGFP sequence at nucleotide positions 3804-4499, a bGH poly(A) signal at nucleotide positions 4509-4748, a factor VIII stuffer sequence at nucleotide positions 4749-5248, an AAV2 ITR sequence at nucleotide positions 5274-5414, a fl(+)ORI at nucleotide positions 5489-5944, an KAN resistance gene at nucleotide positions 6224-7033, and an ORI at nucleotide positions 7112-7700.

In some embodiments of any of the compositions described herein, the vector is pAKOS109 (SEQ ID NO: 52), or is a vector including a sequence that is at least 80%, at least 82%, at least 84%, at least 86%, at least 88%, at least 90%, at least 92%, at least 94%, at least 96%, at least 98%, at least 99%, or 100% identical to SEQ ID NO: 52. pAKOS109 is shown in FIGS. 36, The pAKOS109 vector is 7056 bp in length and has an AAV ITR sequence at nucleotide positions 1-130, a human cytomegalovirus (hCMV) enhancer at nucleotide positions 145-524, a chicken 3-actin promoter at nucleotide positions 527-802, a chimeric intron at nucleotide positions 803-1815, a Kozak sequence at nucleotide positions 1856-1861, a 5' hOTOF isoform 5 sequence at nucleotide positions 1862-4384, a SD intron sequence at nucleotide positions 4385-4466, an AK sequence at nucleotide positions 4467-4543, an AAV2 ITR sequence at nucleotide positions 4569-4709, a fl(+)ORI at nucleotide positions 4784-5239, an KAN resistance gene at nucleotide positions 5519-6328, and an ORI at nucleotide positions 6407-6995.

Figure 38:
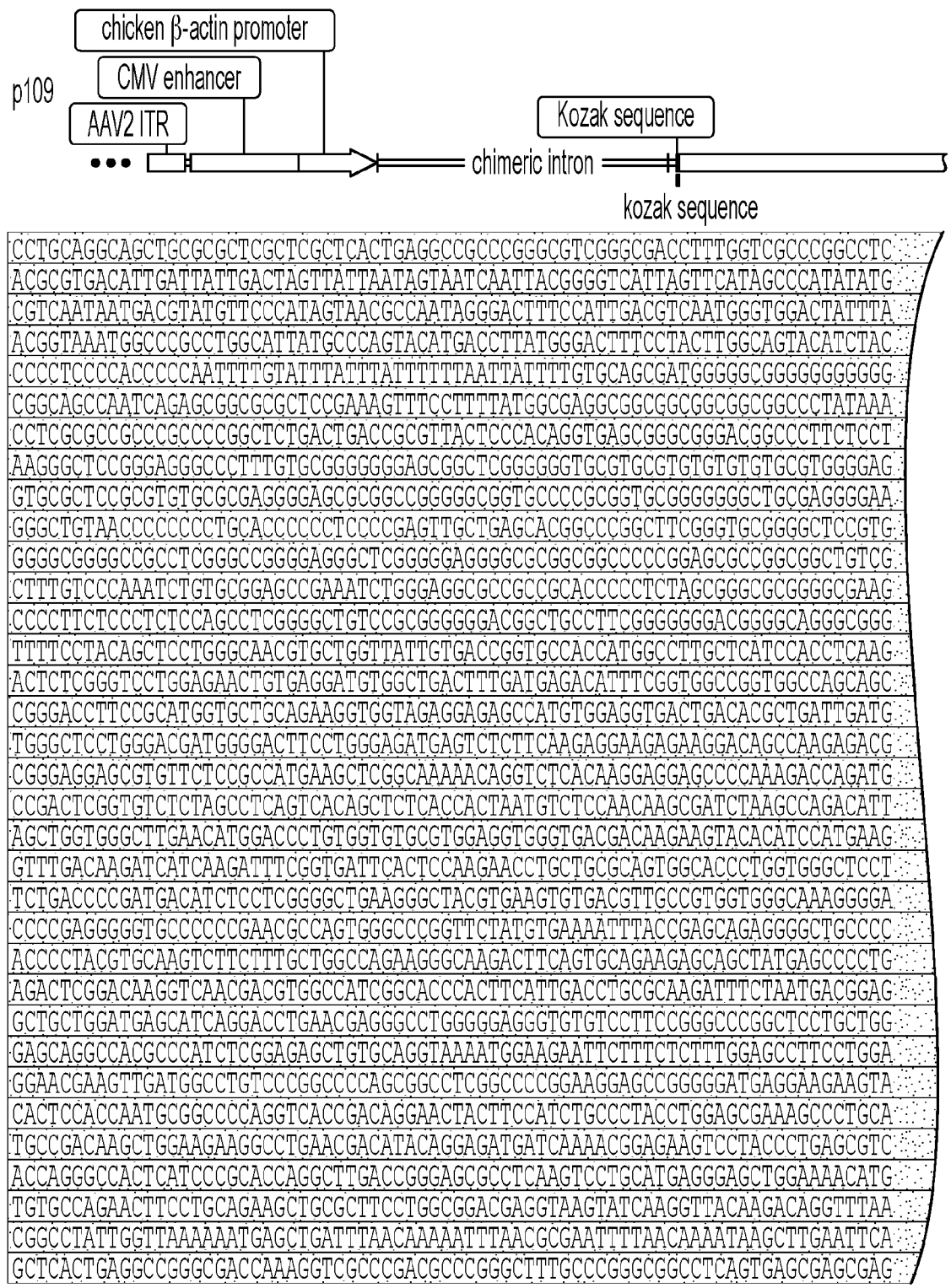
FIG. 38 is a representative schematic of p109 (SEQ ID NO: 84).
Figure 38:
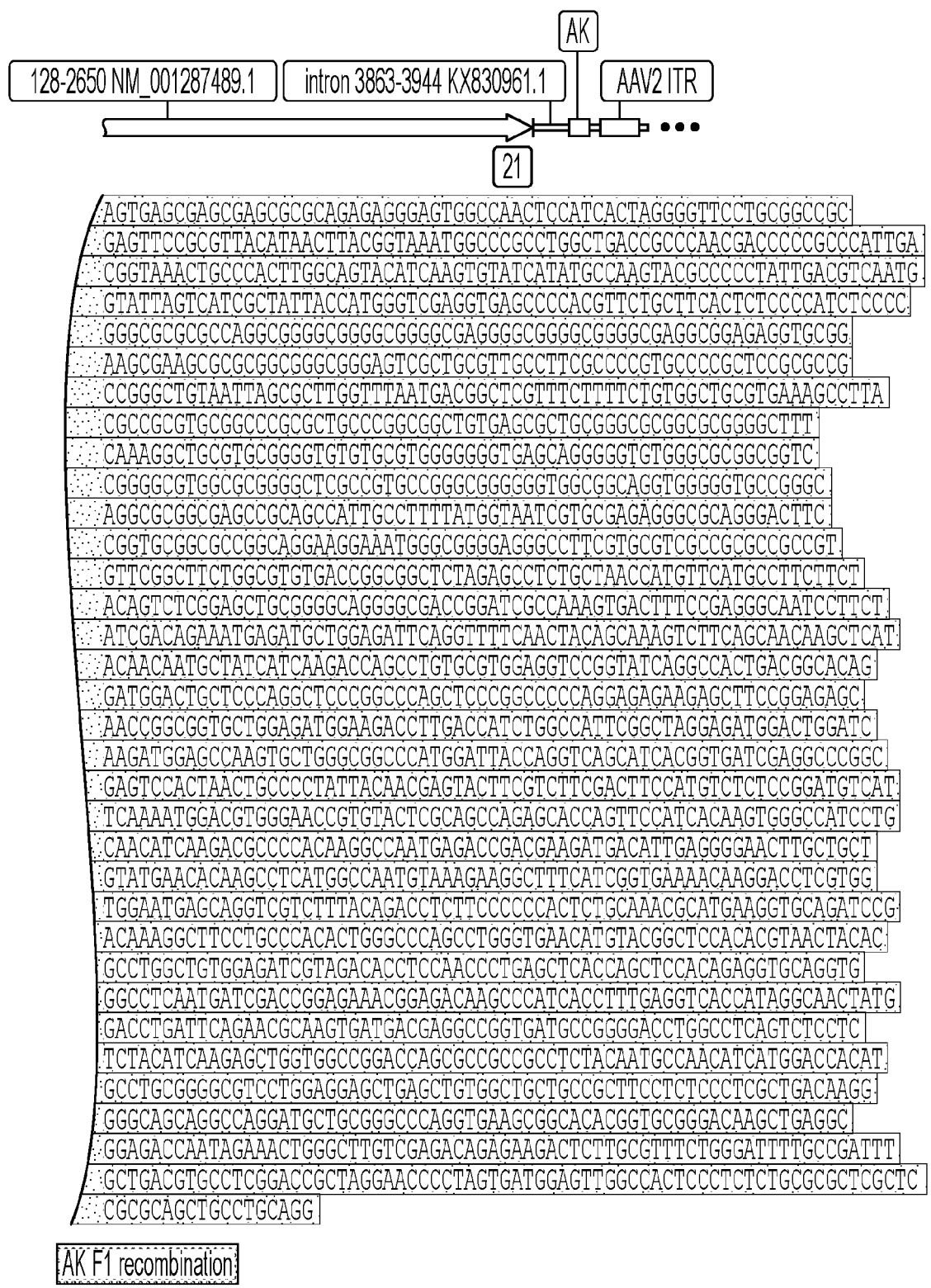

In some embodiments of any of the compositions described herein, the vector is p109 (SEQ ID NO: 84) or is a vector that includes a sequence that is at least 80%, at least 82%, at least 84%, at least 86%, at least 88%, at least 90%, at least 92%, at least 94%, at least 96%, at least 98%, at least 99%, or 100% identical to SEQ ID NO: 84. The p109 vector is 4,711 bp in length and is shown in FIG. 38.

Figure 28:
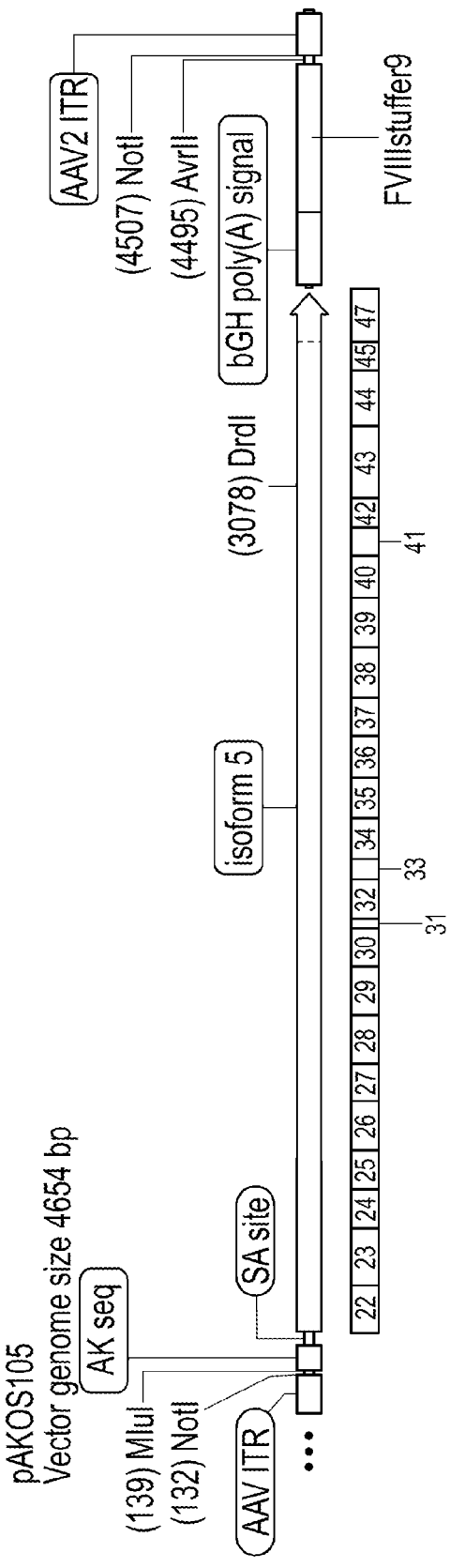
FIG. 28 is a representative schematic of a portion of pAKOS105.
Figure 39:
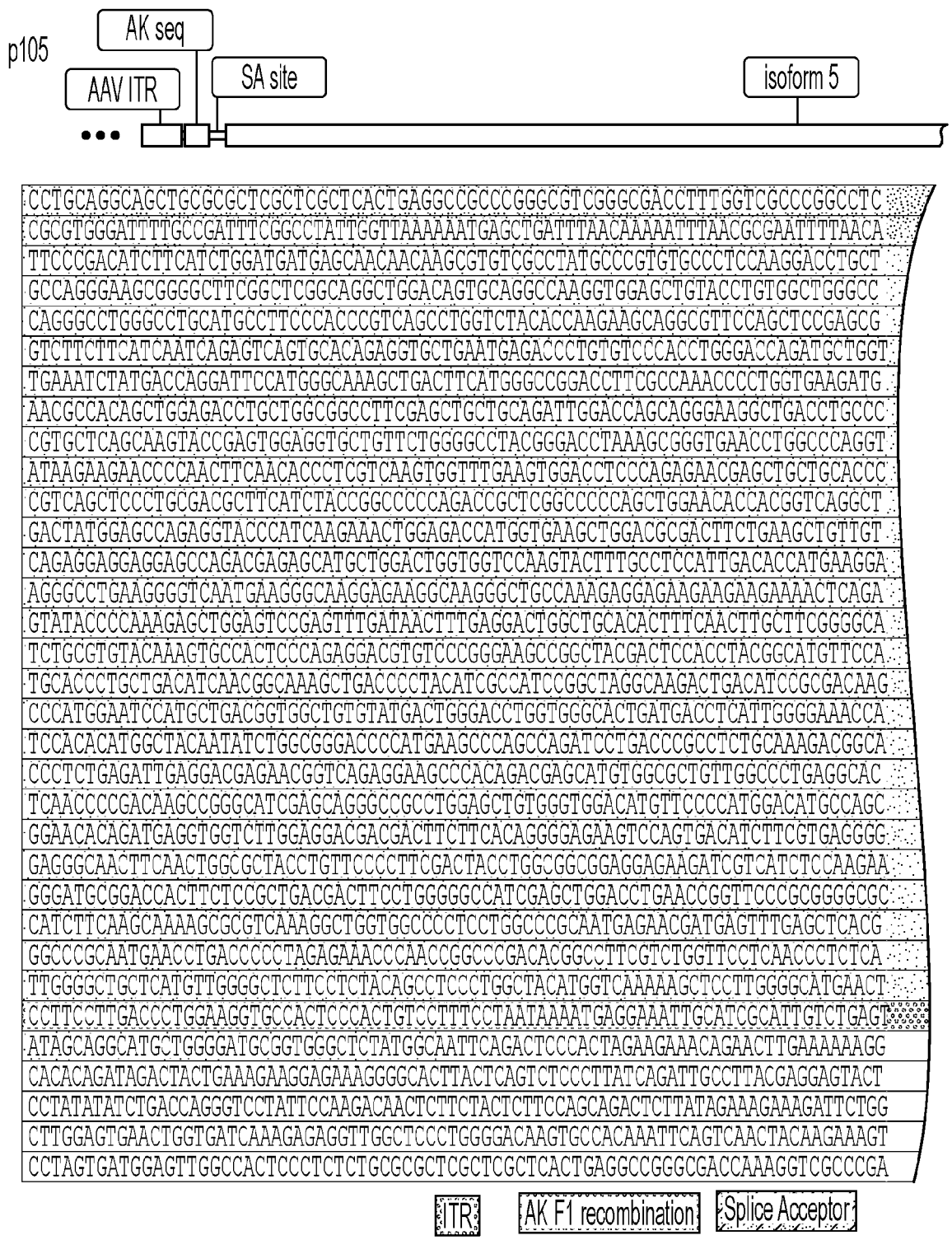
FIG. 39 is a representative schematic of p105 (SEQ ID NO: 85).
Figure 39:
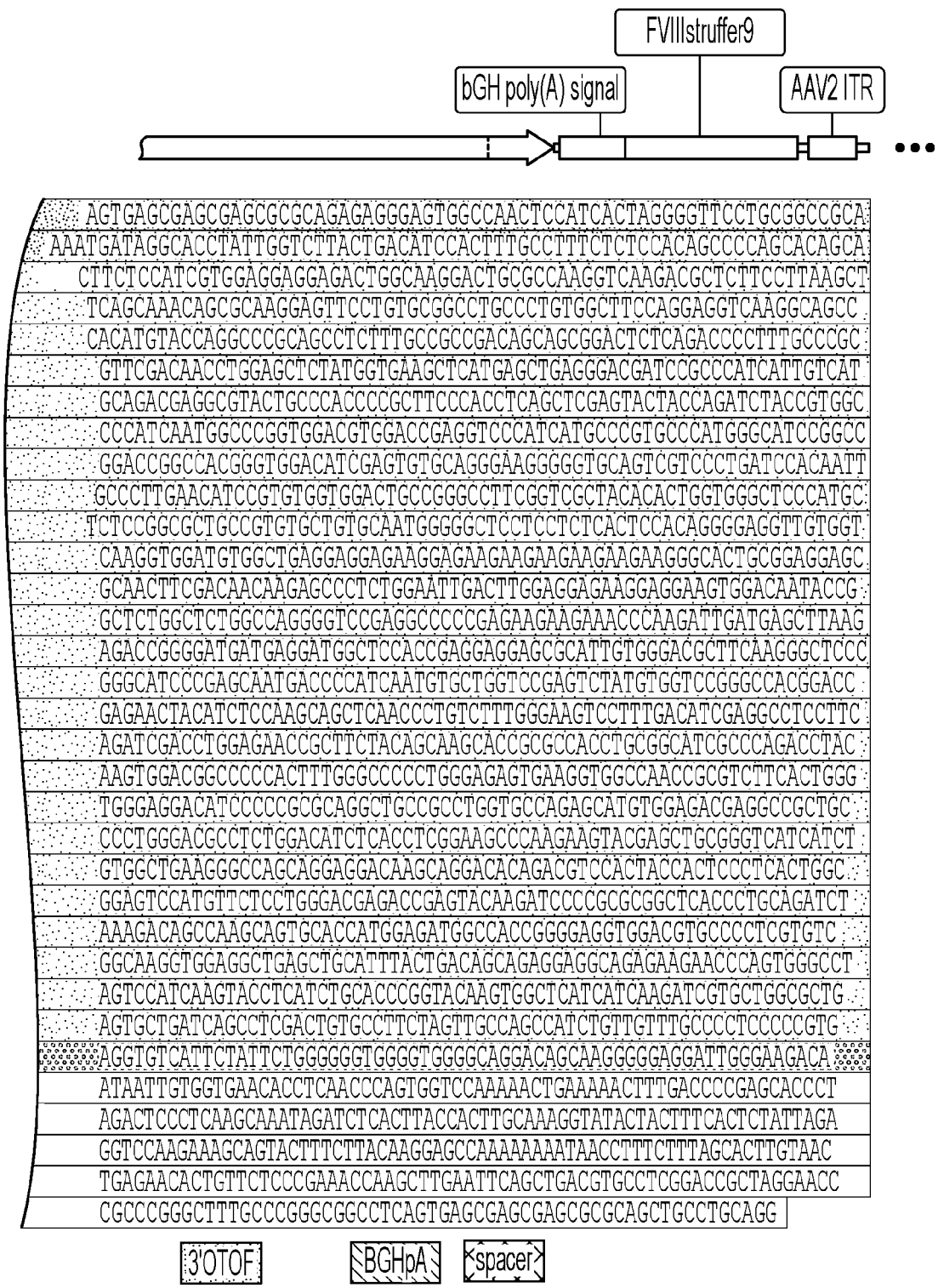

In some embodiments of any of the compositions described herein, the vector is p105 (SEQ ID NO: 85) or is a vector that includes a sequence that is at least 80%, at least 82%, at least 84%, at least 86%, at least 88%, at least 90%, at least 92%, at least 94%, at least 96%, at least 98%, at least 99%, or 100% identical to SEQ ID NO: 85. The p105 vector is 4,664 bp in length and is shown in FIGS. 28 and 39.

Figure 40:
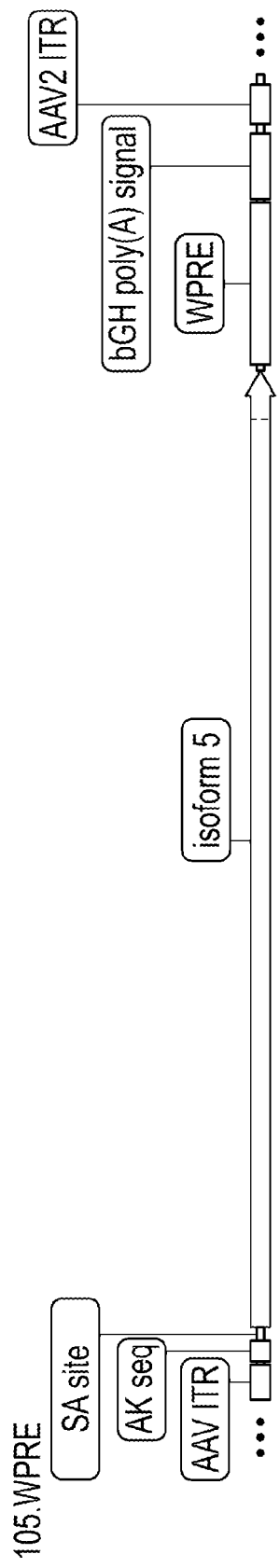
FIG. 40 is a representative schematic of 105.WPRE.

In some embodiments of any of the compositions described herein, the vector is 105.WPRE, shown in FIG. 40. The WPRE sequence present in the 105.WPRE vector is SEQ ID NO: 69.

Figure 41:
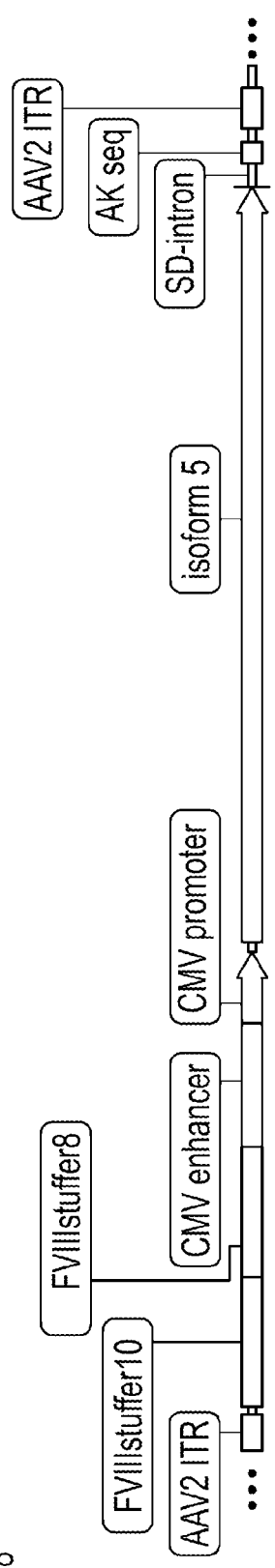
FIG. 41 is a representative schematic of p108.

In some embodiments of any of the compositions described herein, the vector is p108, shown in FIG. 41. The p108 vector includes the FVIII stuffer sequence of SEQ ID NO: 58 and the CMV enhancer and promoter sequence of SEQ ID NO: 70.

Figure 42:
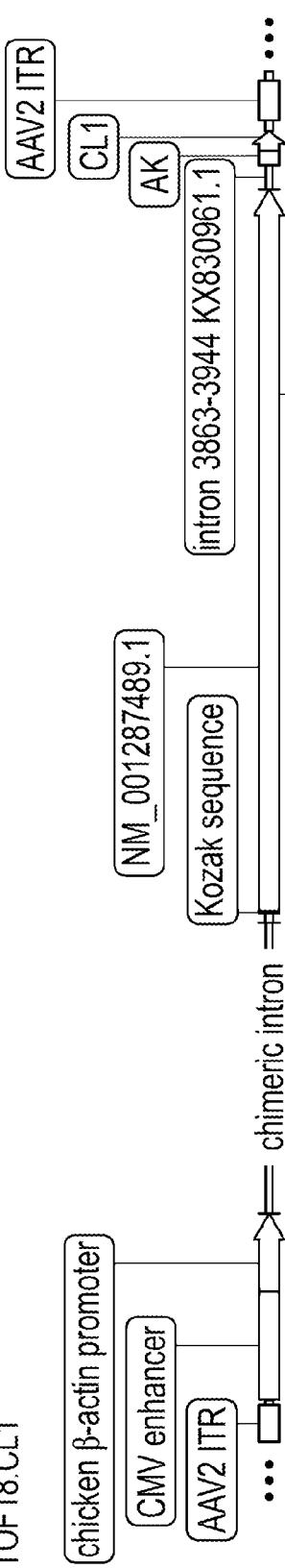
FIG. 42 is a representative schematic of 1OTOF18.CL1.

In some embodiments of any of the compositions described herein, the vector is 1OTOF18.CL1, shown in FIG. 42. The 1OTOF18.CL1 vector includes the CL1 degradation sequence of SEQ ID NO: 71.

Figure 43:
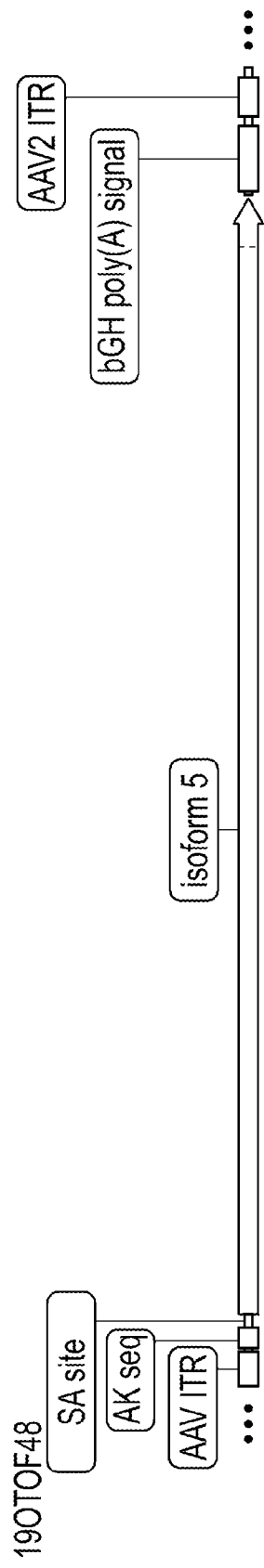
FIG. 43 is a representative schematic of 19OTOF48.

In some embodiments of any of the compositions described herein, the vector is 19OTOF48, shown in FIG. 43.

Figure 44:
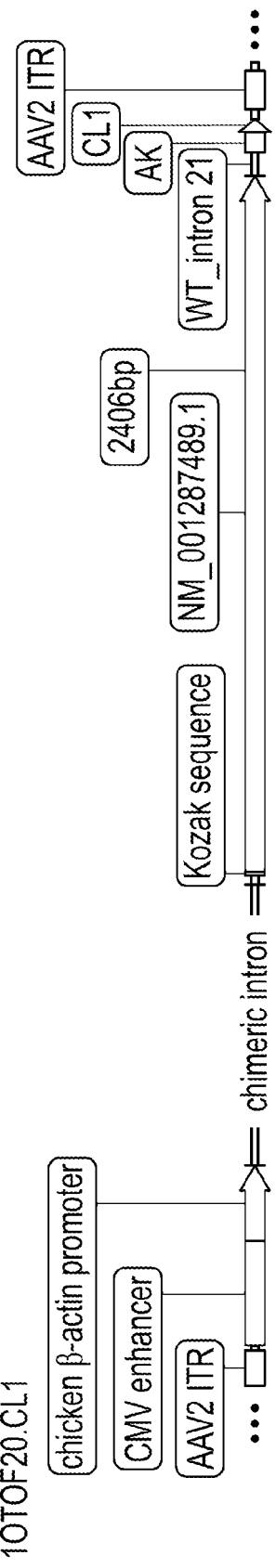
FIG. 44 is a representative schematic of 1OTOF20.CL1.

In some embodiments of any of the compositions described herein, the vector is 1OTOF20.CL1, shown in FIG. 44. The intron 21 splice donor sequence in 1OTOF20, CL1 is SEQ ID NO: 72.

Figure 45:
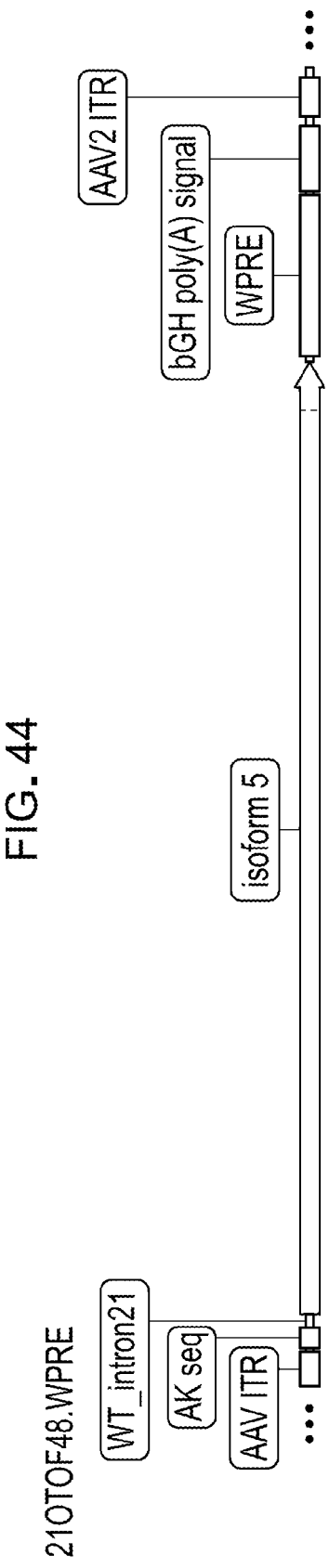
FIG. 45 is a representative schematic of 21OTOF48.WPRE.

In some embodiments of any of the compositions described herein, the vector is 21OTOF48.WPRE, shown in FIG. 45. The intron 21 splice acceptor sequence is SEQ ID NO: 73.

In some embodiments of any of the compositions described herein, the vector is 1OTOF21.CL1, shown in FIG. 46. The intron 22 splice donor sequence is SEQ ID NO: 74.

In some embodiments of any of the compositions described herein, the vector is 22OTOF48.WPRE, shown in FIG. 47. The intron 22 splice acceptor sequence is SEQ ID NO: 75.

In some embodiments of any of the compositions described herein, the vector is 105.pA.NTF3.CMVd, shown in FIG. 48. The 105.pA.NTF3.CMVd vector includes the following sequences: SV40 polyA (SEQ ID NO: 76), HSV-TK poly(A) (SEQ ID NO: 77), sequence encoding human NTF3 (SEQ ID NO: 79), and CMVd (SEQ ID NO: 86).

In some embodiments, a vector can include a CMV enhancer and a chicken J-actin promoter, e.g., a sequence of SEQ ID NO: 61.

In some embodiments of any of the compositions described herein, the vector is pAAV-HBA-eGFP-P2A-5'mOTOF.SD (SEQ ID NO: 87), or is a vector that includes a sequence that is at least 80%, at least 82%, at least 84%, at least 86%, at least 88%, at least 90%, at least 92%, at least 94%, at least 96%, at least 98%, at least 99%, or 100% identical to SEQ ID NO: 87. The pAAV-HBA-eGFP-P2A-5'mOTOF.SD vector is 4,472 bp in length and is shown in FIG. 53. The pAAV-HBA-eGFP-P2A-5'mOTOF.SD vector includes an AAV ITR (SEQ ID NO: 59), a CMV enhancer (SEQ ID NO: 70), a sequence encoding a portion of 5'mOTOF (SEQ ID NO: 94), and a splice donor sequence (SEQ ID NO: 64).

In some embodiments of any of the compositions described herein, the vector is pAAV-SA-3'mOTOF.WPRE (SEQ ID NO: 88), or is a vector that includes a sequence that is at least 80%, at least 82%, at least 84%, at least 86%, at least 88%, at least 90%, at least 92%, at least 94%, at least 96%, at least 98%, at least 99%, or 100% identical to SEQ ID NO: 88. The pAAV-SA-3'mOTOF.WPRE vector is 4,674 bp in length and is shown in FIG. 54. The pAAV-SA-3'mOTOF.WPRE vector includes an AAV ITR (SEQ ID NO: 59), a splice acceptor sequence (SEQ ID NO: 65), a sequence encoding a portion 3'mOTOF (SEQ ID NO: 95), a WPRE sequence (SEQ ID NO: 69), a BGHpA sequence (SEQ ID NO: 68), and an AAV ITR sequence (SEQ ID NO: 60).

In some embodiments of any of the compositions described herein, the vector is pAAV-HBA-eGFP-P2A-5'mOTOF.SD-AK, shown in FIG. 55, and is 4,549 bp in length. The pAAV-HBA-eGFP-P2A-5'mOTOF.SD-AK vector includes an AAV ITR (SEQ ID NO: 59), a CMV enhancer (SEQ ID NO: 70), a sequence encoding a portion 5'mOTOF (SEQ ID NO: 94), a SD-intron sequence (SEQ ID NO: 72), an AK sequence (SEQ ID NO: 67), and an AAV ITR (SEQ ID NO: 60).

In some embodiments of any of the compositions described herein, the vector is pAAV-AK-SA-3'mOTOF-WPRE, shown in FIG. 56 and is 4,751 bp in length. The pAAV-AK-SA-3'mOTOF-WPRE vector includes an AAV ITR (SEQ ID NO: 59), an AK sequence (SEQ ID NO: 66), a sequence encoding a portion of 3' mOTOF (SEQ ID NO: 95), a WPRE sequence (SEQ ID NO: 69), a BGHpA sequence (SEQ ID NO: 68), and an AAV ITR (SEQ ID NO: 60).

Figure 57:
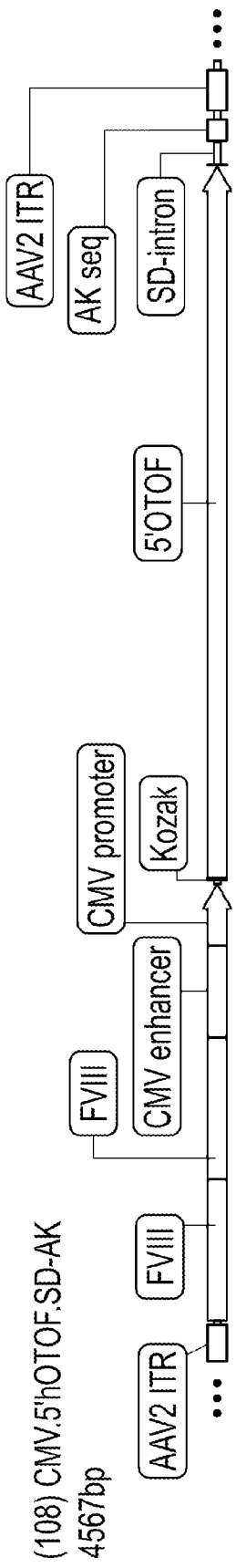
FIG. 57 is a representative schematic of a portion of pAAV-CMV-5'hOTOF-SD-AK.

In some embodiments of any of the compositions described herein, the vector is pAAV-CMV-5'hOTOF-SD-AK (p108 plasmid), shown in FIG. 57 and is 4,567 bp in length. The pAAV-CMV-5'hOTOF-SD-AK vector includes an AAV ITR (SEQ ID NO: 59), a FVII stuffer (SEQ ID NO: 90), a FVII stuffer (SEQ ID NO: 91), a CMV enhancer and promoter (SEQ ID NO: 70), a portion of a sequence encoding 5'hOTOF (SEQ ID NO: 62), a SD intron sequence (SEQ ID NO: 72), an AK sequence (SEQ ID NO: 67), and an AAV ITR sequence (SEQ ID NO: 60). In some embodiments, the vector that includes a sequence that is at least 80%, at least 82%, at least 84%, at least 86%, at least 88%, at least 90%, at least 92%, at least 94%, at least 96%, at least 98%, at least 99%, or 100% identical to SEQ ID NO: 90. In some embodiments, the vector that includes a sequence that is at least 80%, at least 82%, at least 84%, at least 86%, at least 88%, at least 90%, at least 92%, at least 94%, at least 96%, at least 98%, at least 99%, or 100% identical to SEQ ID NO: 91.

Figure 58:
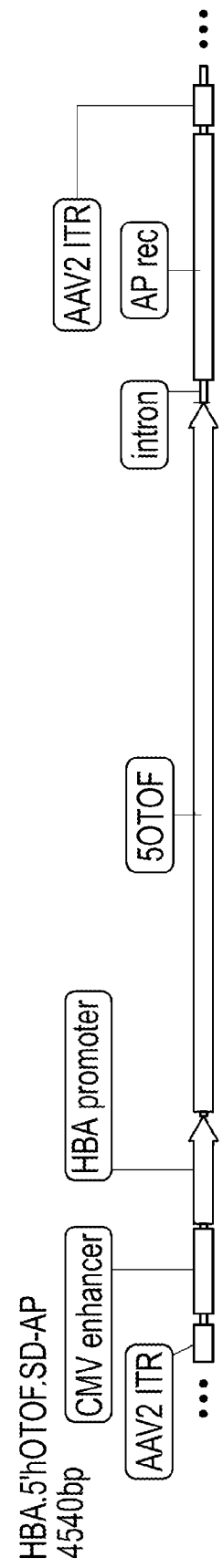
FIG. 58 is a representative schematic of a portion of pAAV-HBA-5'hOTOF-SD-AP.

In some embodiments of any of the compositions described herein, the vector is pAAV-HBA-5'hOTOF-SD-AP, shown in FIG. 58, and is 4,540 bp in length. The pAAV-HBA-5'hOTOF-SD-AP includes an AAV ITR sequence (SEQ ID NO: 59), a CMV enhancer (SEQ ID NO: 70), a sequence encoding a portion 5'hOTOF (SEQ ID NO: 62), an AP rec sequence (SEQ ID NO: 89), and an AAV ITR sequence (SEQ ID NO: 60).

Figure 59:
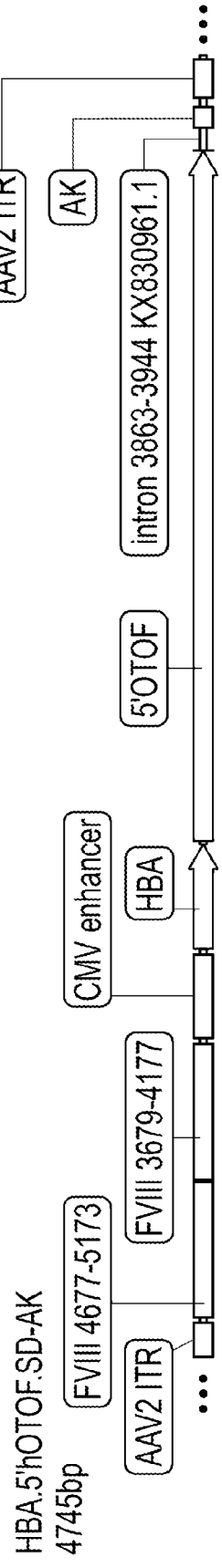
FIG. 59 is a representative schematic of a portion of pAAV-HBA-5'hOTOF-SD-AK.

In some embodiments of any of the compositions described herein, the vector is pAAV-HBA-5'hOTOF-SD-AK, shown in FIG. 59, and is 4,745 bp in length. The pAAV-HBA-5'hOTOF-SD-AK includes an AAV ITR sequence (SEQ ID NO: 59), a FVIII stuffer (4677-5173) sequence (SEQ ID NO: 90), a FVIII stuffer (3679-4177) sequence (SEQ ID: 91), a CMV enhancer (SEQ ID NO: 70), a sequence encoding a portion 5'hOTOF (SEQ ID NO: 62), and an AAV ITR sequence (SEQ ID NO: 60). In some embodiments, the vector includes a sequence that is at least 80%, at least 82%, at least 84%, at least 86%, at least 88%, at least 90%, at least 92%, at least 94%, at least 96%, at least 98%, at least 99%, or 100% identical to SEQ ID NO: 90, or a sequence that is at least 80%, at least 82%, at least 84%, at least 86%, at least 88%, at least 90%, at least 92%, at least 94%, at least 96%, at least 98%, at least 99%, or 100% identical to SEQ ID NO: 91.

In some embodiments of any of the compositions described herein, the vector is pAAV-HBA-5'hOTOFcodop-SD-AK, shown in FIG. 60, and is 4,745 bp in length, The pAAV-CMV-5'hOTOF-SD-AK vector includes an AAV ITR sequence (SEQ ID NO: 59), a FVIII stuffer (4677-5173) sequence (SEQ ID NO: 90), a FVIII stuffer (3679-4177) sequence (SEQ ID: 91), a CMV enhancer (SEQ ID NO: 70), a sequence encoding a portion a 5'OTOF codop sequence (SEQ ID NO: 92), an AK sequence (SEQ ID NO: 67), and an AAV ITR sequence (SEQ ID NO: 60). In some embodiments, the vector that includes a sequence that is at least 80%, at least 82%, at least 84%, at least 86%, at least 88%, at least 90%, at least 92%, at least 94%, at least 96%, at least 98%, at least 99%, or 100% identical to SEQ ID NO: 90. In some embodiments, the vector that includes a sequence that is at least 80%, at least 82%, at least 84%, at least 86%, at least 88%, at least 90%, at least 92%, at least 94%, at least 96%, at least 98%, at least 99%, or 100% identical to SEQ ID NO: 91.

In some embodiments of any of the compositions described herein, the vector is pAAV-HBA-5'hOTOFcodop-SD, shown in FIG. 61, and is 4,668 bp in length. The pAAV-HBA-5'hOTOFcodop-SD vector includes an AAV ITR sequence (SEQ ID NO: 59), a FVIII stuffer (4677-5173) sequence (SEQ ID NO: 90), a FVIII stuffer (3679-4177) sequence (SEQ ID: 91), a CMV enhancer (SEQ ID NO: 70), a sequence encoding a portion 5'OTOF codop sequence (SEQ ID NO: 92), and an AAV ITR sequence (SEQ ID NO: 60). In some embodiments, the vector that includes a sequence that is at least 80%, at least 82%, at least 84%, at least 86%, at least 88%, at least 90%, at least 92%, at least 94%, at least 96%, at least 98%, at least 99%, or 100% identical to SEQ ID NO: 90. In some embodiments, the vector that includes a sequence that is at least 80%, at least 82%, at least 84%, at least 86%, at least 88%, at least 90%, at least 92%, at least 94%, at least 96%, at least 98%, at least 99%, or 100% identical to SEQ ID NO: 91.

In some embodiments of any of the compositions described herein, the vector is pAAV-CMV-5'hOTOF-SD, shown in FIG. 62, and is 4,490 bp in length. The pAAV-CMV-5'hOTOF-SD vector includes an AAV ITR sequence (SEQ ID NO: 59), two FVIII stuffer sequences, a CMV enhancer and promoter (SEQ ID NO: 70), a sequence encoding a portion of a 5'OTOF codop sequence (SEQ ID NO: 92), a SD-intron sequence (SEQ ID NO: 64), and an AAV ITR sequence (SEQ ID NO: 60).

Figure 63:
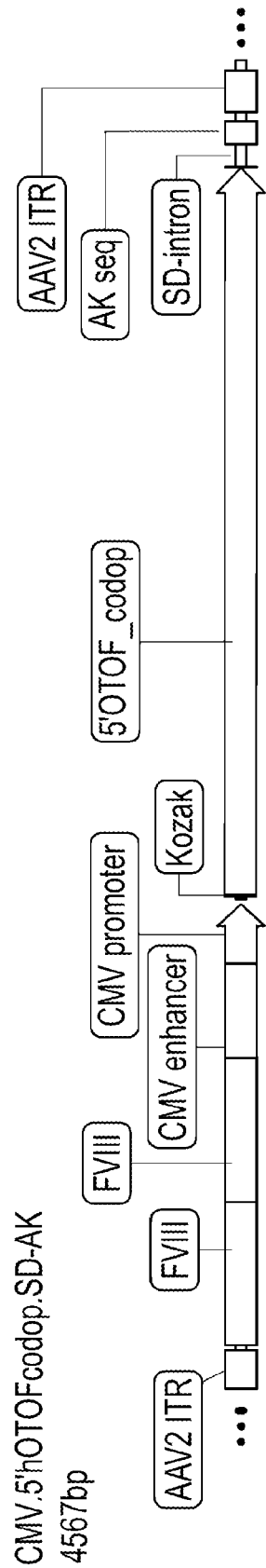
FIG. 63 is a representative schematic of a portion of pAAV-CMV-5'hOTOFcodop-SD-AK.

In some embodiments of any of the compositions described herein, the vector is pAAV-CMV-5'hOTOF-SD-AK, shown in FIG. 63, and is 4,567 bp in length. The pAAV-CMV-5'hOTOF-SD-AK vector includes an AAV ITR sequence (SEQ ID NO: 59), two FVIII stuffer sequences, a CMV enhancer and promoter (SEQ ID NO: 70), a sequence encoding a portion of a 5'OTOF codop sequence (SEQ ID NO: 92), a splice donor (SD) intron sequence (SEQ ID NO: 64), an AK sequence (SEQ ID NO: 67), and an AAV ITR sequence (SEQ ID NO: 60).

Figure 64:
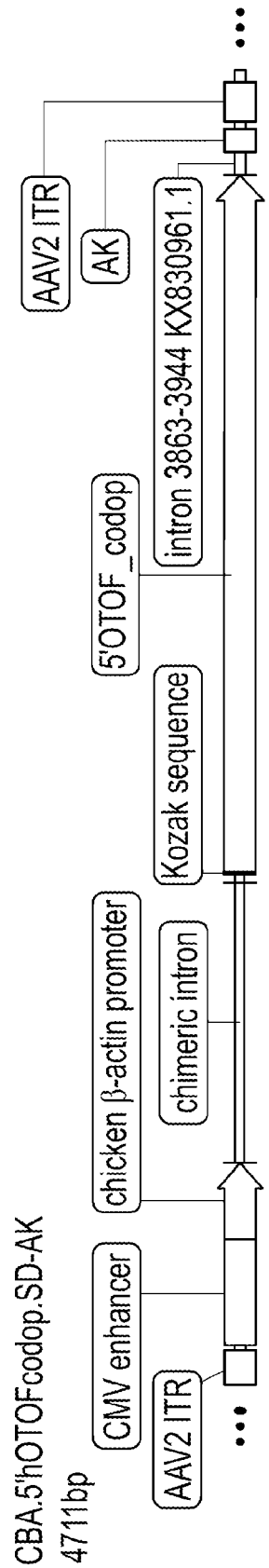
FIG. 64 is a representative schematic of a portion of pAAV-CBA-5'hOTOFcodop-SD-AK.

In some embodiments of any of the compositions described herein, the vector is pAAV-CBA-5'hOTOF-SD-AK, shown in FIG. 64, and is 4,711 bp in length. The pAAV-CBA-5'hOTOF-SD-AK vector includes an AAV ITR sequence (SEQ ID NO: 59), a CMV enhancer and chicken beta-actin promoter (SEQ ID NO: 61), a chimeric intronic sequence, a sequence encoding a portion of a 5'hOTOF codop sequence (SEQ ID NO: 92), an intronic sequence, an AK sequence (SEQ ID NO: 67), and an AAV ITR sequence (SEQ ID NO: 60).

Figure 65:
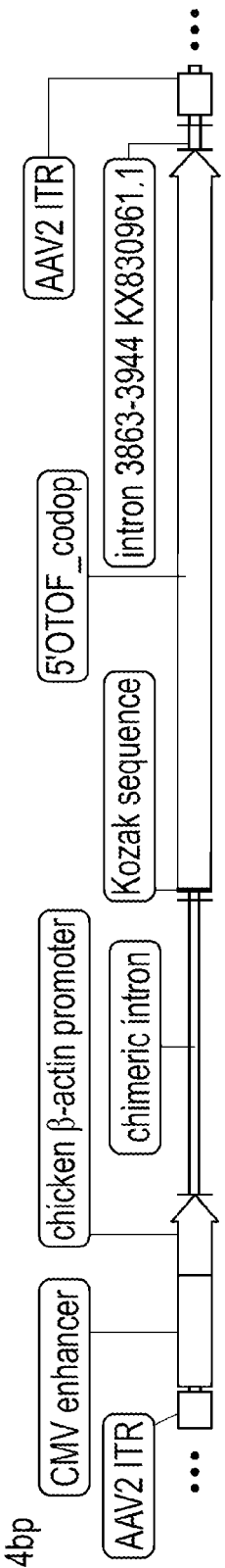
FIG. 65 is a representative schematic of a portion of pAAV-CBA-5'hOTOF-SD.

In some embodiments of any of the compositions described herein, the vector is pAAV-CBA-5'hOTOF-SD, shown in FIG. 65, and is 4,634 bp in length. The pAAV- CBA-5'hOTOF-SD vector includes an AAV ITR sequence (SEQ ID NO: 59), a CMV enhancer and beta-actin promoter (SEQ ID NO: 61), a chimeric intronic sequence, a sequence encoding a portion of a 5'OTOF codop sequence (SEQ ID NO: 92), an intronic sequence, and an AAV ITR sequence (SEQ ID NO: 60).

Figures 66, 67, 68:
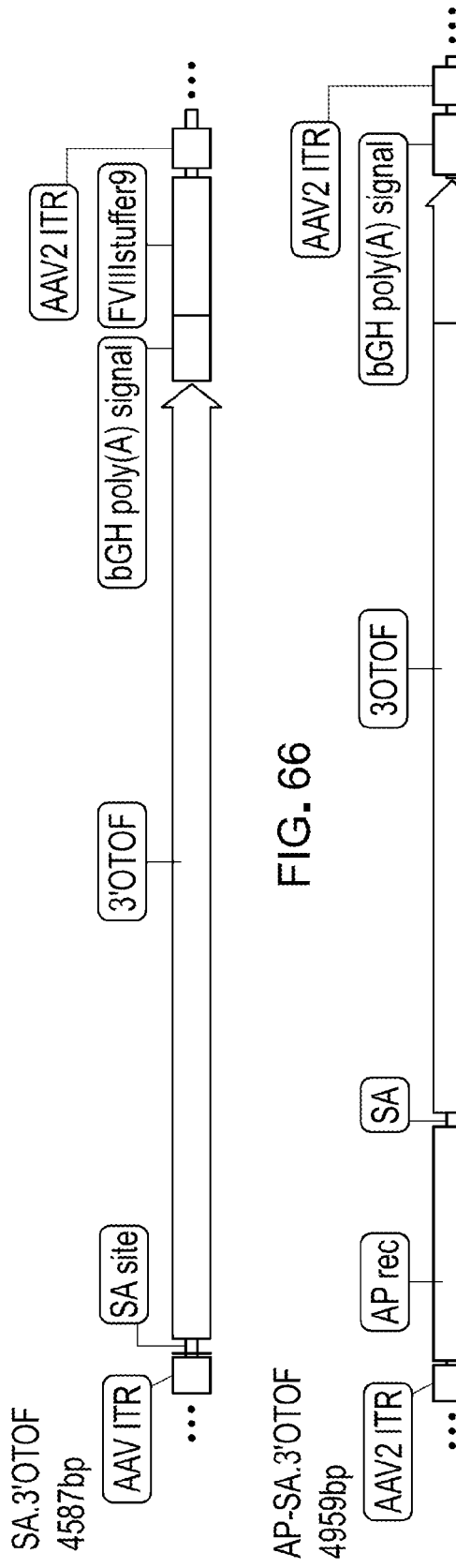
FIG. 66 is a representative schematic of a portion of pAAV-SA-3'OTOF.
FIG. 67 is a representative schematic of a portion of pAAV-AP-SA-3'OTOF.
FIG. 68 is a representative schematic of a portion of pAAV-AK-SA-3'OTOFcodop.
Figures 69, 70, 71:
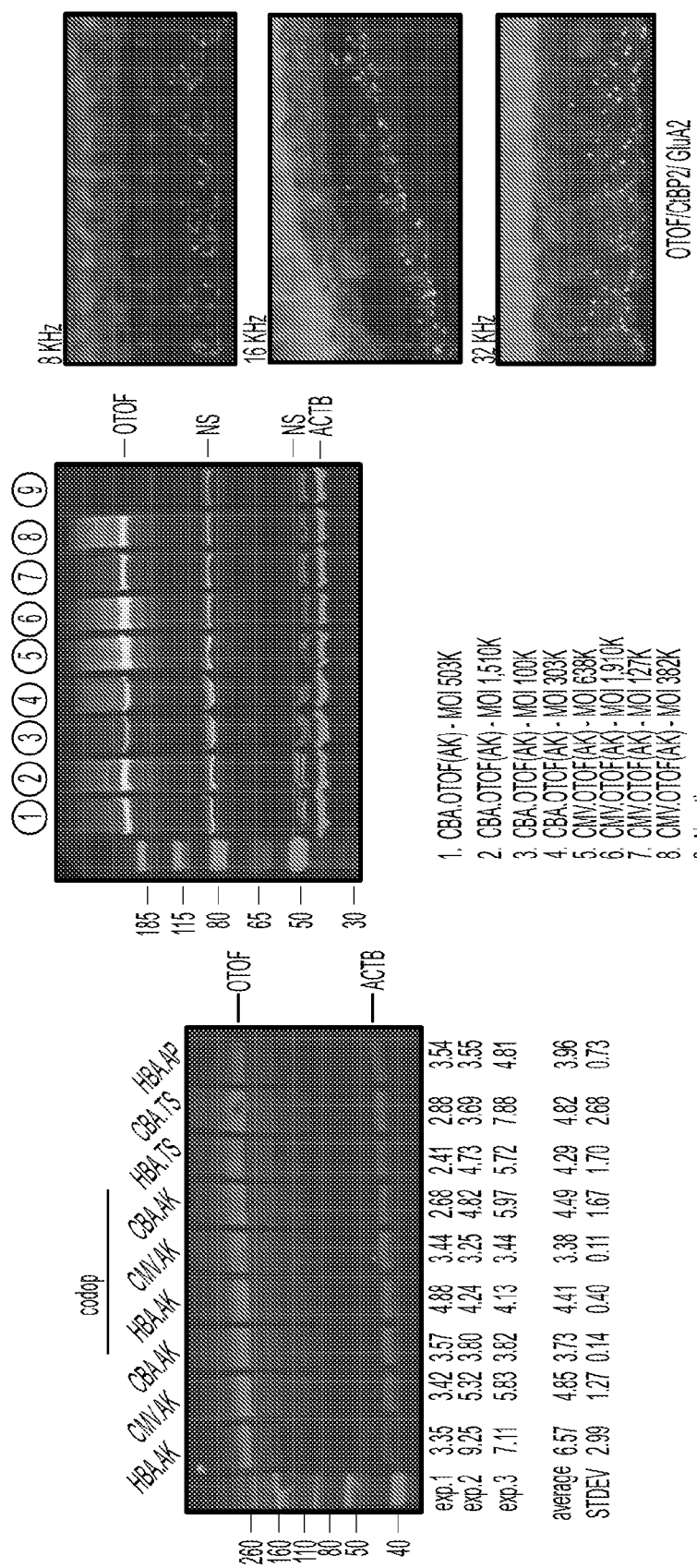
FIG. 69 is a representative immunoblot showing the expression of full-length human otoferlin in HEK293FT cells transfected using DNA transfection reagent jetPRIME® (polyplus) with 600 ng of the different pairs of plasmids indicated. Lane 1 contained a prestained protein ladder. Lane 2 contained a protein sample of HEK293FT cells that were transfected with vector pAKOS104 (as shown in FIGS. 24 and 59) and vector pAKOS105 (as shown in FIGS. 27, 28 and 39). Lane 3 contained a protein sample of HEK293FT cells that were transfected with vector pAKOS108 (as shown in FIGS. 34, 35, 41 and 57) and vector pAKOS105 (as shown in FIGS. 27, 28 and 39). Lane 4 contained a protein sample of HEK293FT cells that were transfected with vector pAKOS109 (as shown in FIGS. 36 and 38) and vector pAKOS105 (as shown in FIGS. 27, 28 and 39). Lane 5 contained a protein sample of HEK293FT cells that were transfected with vector pAAV-HBA-5'hOTOFcodop-SD-AK (as shown in FIG. 60) and vector pAAV-AK-SA-3'OTOFcodop (as shown in FIG. 68). Lane 6 contained a protein sample of HEK293FT cells that were transfected with vector pAAV-CMV-5'hOTOFcodop-SD-AK (as shown in FIG. 63) and vector pAAV-AK-SA-3'OTOFcodop (as shown in FIG. 68). Lane 7 contained a protein sample of HEK293FT cells that were transfected with vector pAAV_CBA-5'hOTOFcodop-SD-AK (as shown in FIG. 64) and vector pAAV-AK-SA-3'OTOFcodop (as shown in FIG. 68). Lane 8 contained a protein sample of HEK293FT cells that were transfected with vector pAKOS102 (as shown in FIG. 21) and vector pAKOS103 (as shown in FIGS. 22, 23 and 66). Lane 9 contained a protein sample of HEK293FT cells that were transfected with a CBA.TS vector and vector pAKOS103 (as shown in FIGS. 22, 23 and 66). Lane 10 contained a protein sample of HEK293FT cells that were transfected with vector pAKOS106 (as shown in FIGS. 30, 31 and 58) and pAKOS107 (as shown in FIGS. 32, 33 and 67). Ninety-six hours post-transfection, cells were harvested and lysed using RIPA buffer and analyzed in 4-12% Bolt protein gel, which was then transferred onto a nitrocellulose membrane. Human otoferlin was detected using an anti-OTOF polyclonal antibody (Thermo PA5-52935). Human beta-actin was used as the primary antibody for internal loading control between lanes. The experiment was repeated in triplicate. Relative quantitative measurements for each experiment are provided under the immunoblot, along with the average measurement and standard deviation (STDEV).
FIG. 70 is an immunoblot showing the expression of full-length human otoferlin in HEK293FT cells transfected with the different pairs of plasmids indicated at different multiplicity of infections (MOI). HEK293FT cells were seeded overnight at $4\times10^4$ cells/well on a 96-well plate. Six hours post-seeding, the dual vectors were added to each well. Ninety-six hours post-transfection, cells were harvested and lysed using RIPA buffer and analyzed in 4-12% Bolt protein gel, which was then transferred onto a nitrocellulose membrane. Human otoferlin was detected using an anti-OTOF polyclonal antibody (Thermo PA5-52935). Human beta-actin was used as the primary antibody for internal loading control between lanes. Lane 1: CBA.OTOF (AK) with MOI 503,000; lane 2: CBA.OTOF(AK) with MOI 1,510,000; lane 3: CBA.OTOF(AK) with MOI 100,000; lane 4: CBA.OTOF(AK) with MOI 303,000; lane 5: CMV.OTOF(AK) with MOI 638,000; lane 6: CMV.OTOF (AK) with MOI 1,910,000; lane 7: CMV.OTOF(AK) with MOI 127,000; lane 8: CMV.OTOF(AK) with MOI 382,000; lane 9: negative control.
FIG. 71 a set of immunohistochemical images of one organ of Corti from an Otof−/− mouse age P17 after unilateral intracochlear administration of dual-AAV vectors expressing CBA.hOTOF(AK) (p105 and 109 vectors). Ipsilateral cochlea was dissected and analyzed for protein expressing using immunohistochemistry at three different frequency regions (base-apex).
Figure 72:
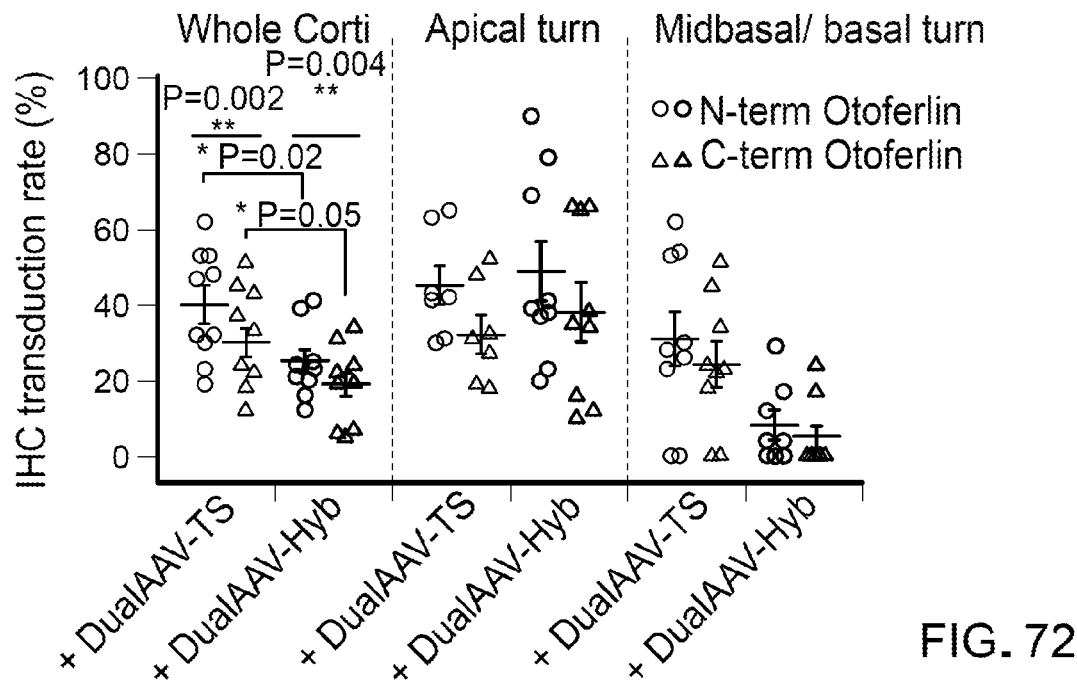
FIG. 72 is a graph showing the percentage of N- and C-terminal otoferlin labeled inner hair cells (IHC) in dual-AAV-TS (n=10 mice) and dual-AAV-Hyb (n=9 mice) injected CD1B6F1-Otof$^{-/-}$ mice (aged P18-P30). Individual animals are depicted with open symbols. Data are displayed as mean±standard error of mean (s.e.m.), ns P>0.05; *P≤0.05; P≤0.01; *P≤0.001, Wilcoxon matched-pair signed rank test, and unpaired t-test with Welch's correction.
Figure 73:
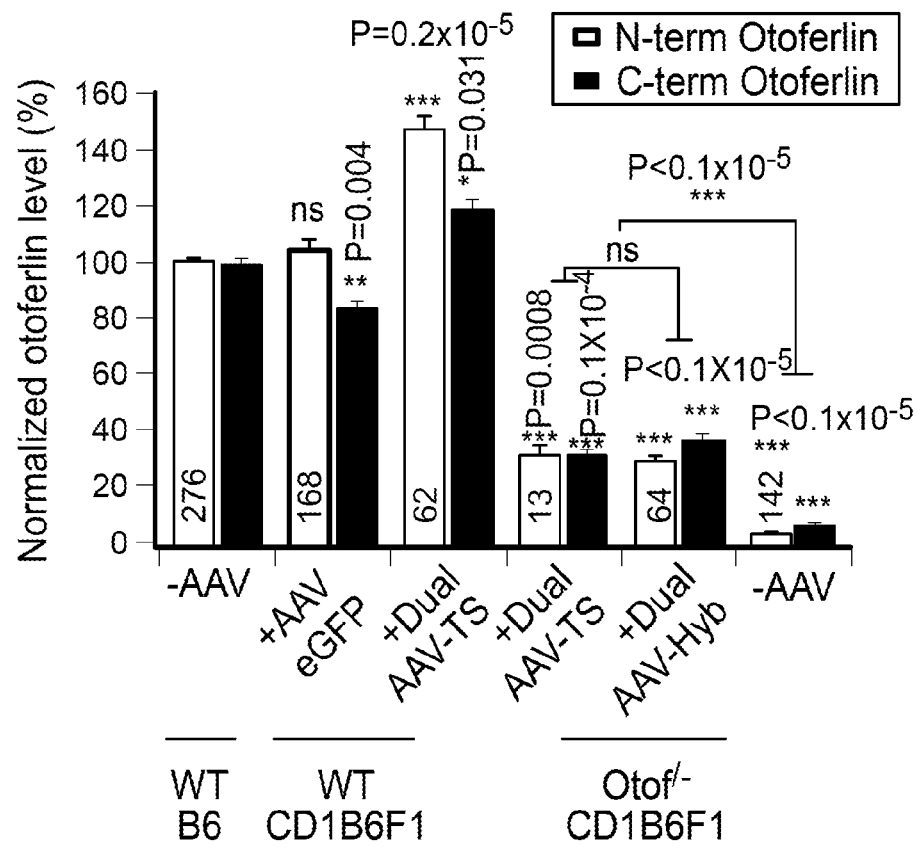
FIG. 73 is a graph showing the average N-terminal and C-terminal otoferlin immunofluorescence levels in dual-AAV-transduced Otof$^{-/-}$ and wild-type inner hair cells (IHC) from mice (aged P23-30). Otoferlin levels were normalized to immunofluorescence levels in non-transduced B6 wild-type IHCs for each antibody separately. The number of quantified IHCs is indicated inside the bars. Data are displayed as mean±standard error of mean (s.e.m.), ns P>0.05; *P≤0.05; P≤0.01; *P≤0.001, Kruskal-Wallis test followed by Dunn's multiple comparison test.
Figure 74:
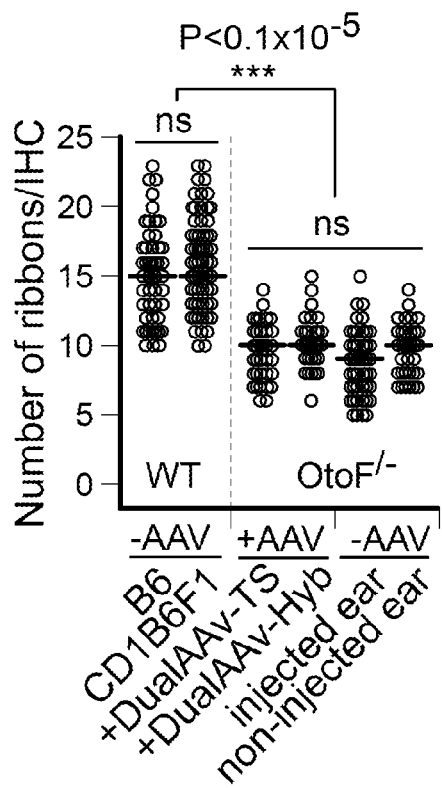
FIG. 74 is a graph showing synaptic ribbon numbers quantified from inner hair cells (IHCs) in apical cochlear turns of wild-type (B6: n=48 IHCs, CD1B6F1: n=108 IHCs), transduced Otof$^{-/-}$ (dualAAV-TS: n=59 IHCs, dualAAV-Hyb: n=37 IHCs), and non-transduced Otof$^{-/-}$ IHCs from injected (−AAV-injected ear, n=65 IHCs) and contralateral non-injected (−AAV non-injected ear, n=46 IHCs) ears (from mice aged P25-P29. Individual animals are depicted with open symbols. Data are displayed as mean±standard error of mean (s.e.m.), ns P>0.05, **P≤0.001 (Kruskal-Wallis test followed by Dunn's multiple comparison test).
Figure 75:
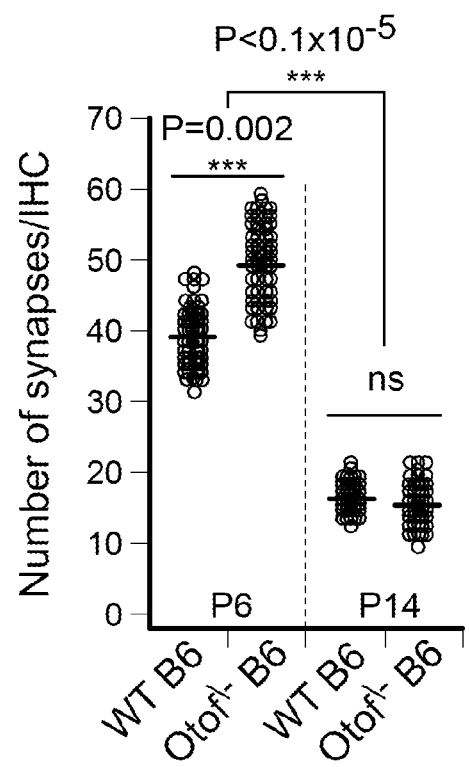
FIG. 75 is a graph showing synapse numbers quantified from inner hair cells (IHCs) in apical turns (c) of B6 wild-type (P6: n=53 IHCs; P14: n=73 IHCs) and B6 Otof$^{-/-}$ (P6: n=62 IHCs; P14: n=65 IHCs) mice at two different developmental stages (P6 and P14). Individual animals are depicted with open symbols. Data are displayed as mean±standard error of mean (s.e.m.), ns P>0.05, **P≤0.001 (Kruskal-Wallis test followed by Dunn's multiple comparison test).
Figure 76:
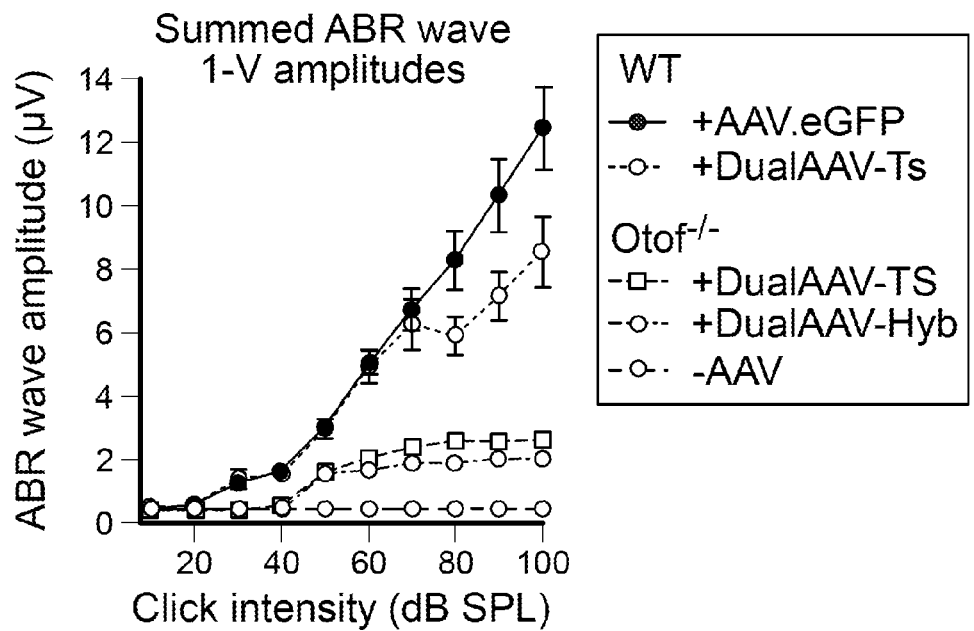
FIG. 76 is a graph showing summed auditory brainstem response (ABR) wave I-V amplitudes at different click sound intensities in otoferlin dual-AAV-injected, non-injected Otof$^{-/-}$, and wild-type control mice aged P23-30. Number of analyzed mice: CD1B6F1 wild-type animals (+AAV.eGFP: n=12 mice, dualAAV-TS: n=6 mice) and CD1B6F1 Otof$^{-/-}$ animals (dualAAV-TS: n=16 mice, dualAAV-Hyb: n=8 mice, =AAV: n=38 mice). Data are represented as mean±standard error of mean (s.e.m.) Individual animals are depicted with open symbols.
Figure 77:
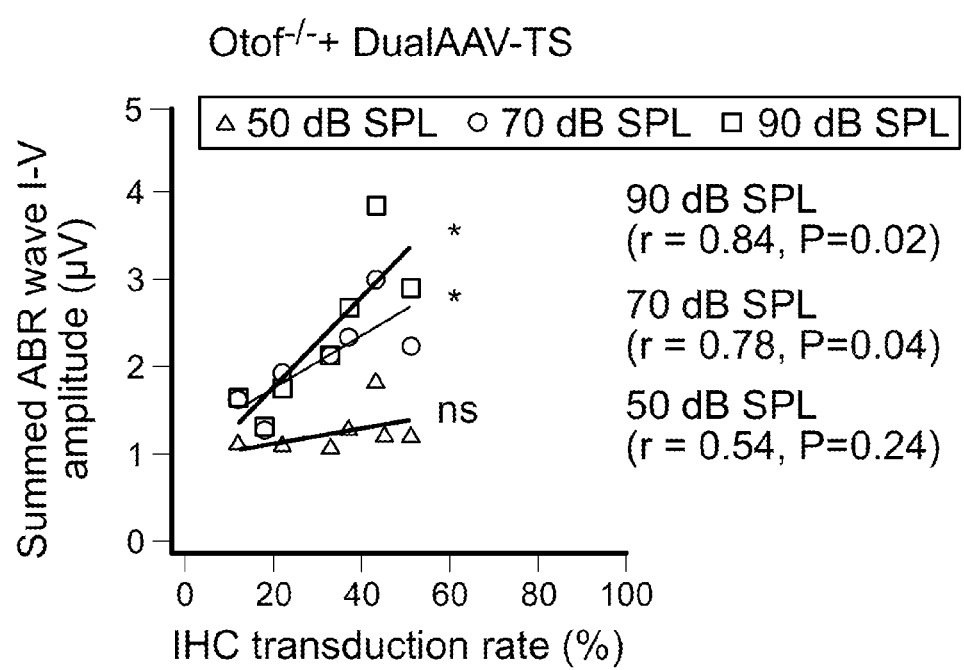
FIG. 77 is a graph showing summer auditory brainstem response (ABR) wave I-V amplitudes of individual dual-AAV-TS treated CD1B6F1 Otof$^{-/-}$, animals (n=8 animals; from FIG. 76) plotted against their full-length otoferlin inner hair cell (IHC) transduction rate (from FIG. 5, C-terminal otoferlin). r: correlation coefficient. =8 mice, =AAV: n=38 mice). Individual animals are depicted with open symbols. r≥0.5 positive correlation (70 decibel of sound pressure level (dB SPL) and 90 dB SPL: Pearson correlation test; 50 dB SPL: Spearman correlation test).

In some embodiments of any of the compositions described herein, the vector is pAAV-SA-3'OTOF, shown in FIG. 66, and is 4,587 bp in length. The pAAV-CBA-5'hOTOF-SD vector includes an AAV ITR sequence (SEQ ID NO: 59), a splice acceptor sequence (SEQ ID NO: 65), a sequence encoding a portion 3'OTOF sequence (SEQ ID NO: 63), a bGHpA sequence (SEQ ID NO: 68), a FVIII stuffer 9 sequence (SEQ ID NO: 57), and an AAV ITR sequence (SEQ ID NO: 60).

In some embodiments of any of the compositions described herein, the vector is pAAV-AP-SA-3'OTOF, shown in FIG. 67, and is 4,959 bp in length. The pAAV-AP-SA-3'OTOF vector includes an AAV ITR sequence (SEQ ID NO: 59), an AP rec sequence (SEQ ID NO: 89), a splice acceptor sequence (SEQ ID NO: 65), a sequence encoding a portion of a 3'OTOF sequence (SEQ ID NO: 63), a bGHpolyA sequence (SEQ ID NO: 68), and an AAV ITR sequence (SEQ ID NO: 60).

In some embodiments of any of the compositions described herein, the vector is pAAV-AK-SA-3'OTOFcodop, shown in FIG. 68, and is 4,664 bp in length. The pAAV-AK-SA-3'OTOFcodop vector includes an AAV ITR (SEQ ID NO: 59), an AK sequence (SEQ ID NO: 66), a sequence encoding a portion of a 3'OTOF codop sequence (SEQ ID NO: 93), a bGH polyA sequence (SEQ ID NO: 68), and an AAV ITR sequence (SEQ ID NO: 60).

The vectors provided herein can be of different sizes. The choice of vector that is used in any of the compositions, kits, and methods described herein may depend on the size of the vector.

In some embodiments, the vector(s) is a plasmid and can include a total length of up to about 1 kb, up to about 2 kb, up to about 3 kb, up to about 4 kb, up to about 5 kb, up to about 6 kb, up to about 7 kb, up to about 8 kb, up to about 9 kb, up to about 10 kb, up to about 11 kb, up to about 12 kb, up to about 13 kb, up to about 14 kb, or up to about 15 kb. In some embodiments, the vector(s) is a plasmid and can have a total length in a range of about 1 kb to about 2 kb, about 1 kb to about 3 kb, about 1 kb to about 4 kb, about 1 kb to about 5 kb, about 1 kb to about 6 kb, about 1 kb to about 7 kb, about 1 kb to about 8 kb, about 1 kb to about 9 kb, about 1 kb to about 10 kb, about 1 kb to about 11 kb, about 1 kb to about 12 kb, about 1 kb to about 13 kb, about 1 kb to about 14 kb, about 1 kb to about 15 kb, about 2 kb to about 3 kb, about 2 kb to about 4 kb, about 2 kb to about 5 kb, about 2 kb to about 6 kb, about 2 kb to about 7 kb, about 2 kb to about 8 kb, about 2 kb to about 9 kb, about 2 kb to about 10 kb, about 2 kb to about 11 kb, about 2 kb to about 12 kb, about 2 kb to about 13 kb, about 2 kb to about 14 kb, about 2 kb to about 15 kb, about 3 kb to about 4 kb, about 3 kb to about 5 kb, about 3 kb to about 6 kb, about 3 kb to about 7 kb, about 3 kb to about 8 kb, about 3 kb to about 9 kb, about 3 kb to about 10 kb, about 3 kb to about 11 kb, about 3 kb to about 12 kb, about 3 kb to about 13 kb, about 3 kb to about 14 kb, about 3 kb to about 15 kb, about 4 kb to about 5 kb, about 4 kb to about 6 kb, about 4 kb to about 7 kb, about 4 kb to about 8 kb, about 4 kb to about 9 kb, about 4 kb to about 10 kb, about 4 kb to about 11 kb, about 4 kb to about 12 kb, about 4 kb to about 13 kb, about 4 kb to about 14 kb, about 4 kb to about 15 kb, about 5 kb to about 6 kb, about 5 kb to about 7 kb, about 5 kb to about 8 kb, about 5 kb to about 9 kb, about 5 kb to about 10 kb, about 5 kb to about 11 kb, about 5 kb to about 12 kb, about 5 kb to about 13 kb, about 5 kb to about 14 kb, or about 5 kb to about 15 kb.

In some embodiments, the vector(s) is a transposon (e.g., PiggyBac transposon) and can include greater than 200 kb. In some examples, the vector(s) is a transposon having a total length in the range of about 1 kb to about 10 kb, about 1 kb to about 20 kb, about 1 kb to about 30 kb, about 1 kb to about 40 kb, about 1 kb to about 50 kb, about 1 kb to about 60 kb, about 1 kb to about 70 kb, about 1 kb to about 80 kb, about 1 kb to about 90 kb, about 10 kb to about 20 kb, about 10 kb to about 30 kb, about 10 kb to about 40 kb, about 10 kb to about 50 kb, about 10 kb to about 60 kb, about 10 kb to about 70 kb, about 10 kb to about 90 kb, about 10 kb to about 100 kb, about 20 kb to about 30 kb, about 20 kb to about 40 kb, about 20 kb to about 50 kb, about 20 kb to about 60 kb, about 20 kb to about 70 kb, about 20 kb to about 80 kb, about 20 kb to about 90 kb, about 20 kb to about 100 kb, about 30 kb to about 40 kb, about 30 kb to about 50 kb, about 30 kb to about 60 kb, about 30 kb to about 70 kb, about 30 kb to about 80 kb, about 30 kb to about 90 kb, about 30 kb to about 100 kb, about 40 kb to about 50 kb, about 40 kb to about 60 kb, about 40 kb to about 70 kb, about 40 kb to about 80 kb, about 40 kb to about 90 kb, about 40 kb to about 100 kb, about 50 kb to about 60 kb, about 50 kb to about 70 kb, about 50 kb to about 80 kb, about 50 kb to about 90 kb, about 50 kb to about 100 kb, about 60 kb to about 70 kb, about 60 kb to about 80 kb, about 60 kb to about 90 kb, about 60 kb to about 100 kb, about 70 kb to about 80 kb, about 70 kb to about 90 kb, about 70 kb to about 100 kb, about 80 kb to about 90 kb, about 80 kb to about 100 kb, about 90 kb to about 100 kb, about 1 kb to about 100 kb, about 100 kb to about 200 kb, about 100 kb to about 300 kb, about 100 kb to about 400 kb, or about 100 kb to about 500 kb.

In some embodiments, the vector is a cosmid and can have a total length of up to 55 kb. In some examples, the vector is a cosmid and has a total number of nucleotides of about 1 kb to about 10 kb, about 1 kb to about 20 kb, about 1 kb to about 30 kb, about 1 kb to about 40 kb, about 1 kb to about 50 kb, about 1 kb to about 55 kb, about 10 kb to about 20 kb, about 10 kb to about 30 kb, about 10 kb to about 40 kb, about 10 kb to about 50 kb, about 10 kb to about 55 kb, about 15 kb to about 55 kb, about 15 kb to about 50 kb, about 15 kb to about 40 kb, about 15 kb to about 30 kb, about 15 kb to about 20 kb, about 20 kb to about 55 kb, about 20 kb to about 50 kb, about 20 kb to about 40 kb, about 20 kb to about 30 kb, about 25 kb to about 55 kb, about 25 kb to about 50 kb, about 25 kb to about 40 kb, about 25 kb to about 30 kb, about 30 kb to about 55 kb, about 30 kb to about 50 kb, about 30 kb to about 40 kb, about 35 kb to about 55 kb, about 40 kb to about 55 kb, about 40 kb to about 50 kb, or about 45 kb to about 55 kb.

In some embodiments, the vector(s) is an artificial chromosome and can have a total number of nucleotides of about 100 kb to about 2000 kb. In some embodiments, the artificial chromosome(s) is a human artificial chromosome (HAC) and can have a total number of nucleotides in the range of about 1 kb to about 10 kb, 1 kb to about 20 kb, about 1 kb to about 30 kb, about 1 kb to about 40 kb, about 1 kb to about 50 kb, about 1 kb to about 60 kb, about 10 kb to about 20 kb, about 10 kb to about 30 kb, about 10 kb to about 40 kb, about 10 kb to about 50 kb, about 10 kb to about 60 kb, about 20 kb to about 30 kb, about 20 kb to about 40 kb, about 20 kb to about 50 kb, about 20 kb to about 60 kb, about 30 kb to about 40 kb, about 30 kb to about 50 kb, about 30 kb to about 60 kb, about 40 kb to about 50 kb, about 40 kb to about 60 kb, or about 50 kb to about 60 kb.

In some embodiments, the artificial chromosome(s) is a yeast artificial chromosome (YAC) and can have a total number of nucleotides up to 1000 kb. In some embodiments, the artificial chromosome(s) is a YAC having a total number of nucleotides in the range of about 100 kb to about 1,000 kb, about 100 kb to about 900 kb, about 100 kb to about 800 kb, about 100 kb to about 700 kb, about 100 kb to about 600 kb, about 100 kb to about 500 kb, about 100 kb to about 400 kb, about 100 kb to about 300 kb, about 100 kb to about 200 kb, about 200 kb to about 1,000 kb, about 200 kb to about 900 kb, about 200 kb to about 800 kb, about 200 kb to about 700 kb, about 200 kb to about 600 kb, about 200 kb to about 500 kb, about 200 kb to about 400 kb, about 200 kb to about 300 kb, about 300 kb to about 1,000 kb, about 300 kb to about 900 kb, about 300 kb to about 800 kb, about 300 kb to about 700 kb, about 300 kb to about 600 kb, about 300 kb to about 500 kb, about 300 kb to about 400 kb, about 400 kb to about 1,000 kb, about 400 kb to about 900 kb, about 400 kb to about 800 kb, about 400 kb to about 700 kb, about 400 kb to about 600 kb, about 400 kb to about 500 kb, about 500 kb to about 1,000 kb, about 500 kb to about 900 kb, about 500 kb to about 800 kb, about 500 kb to about 700 kb, about 500 kb to about 600 kb, about 600 kb to about 1,000 kb, about 600 kb to about 900 kb, about 600 kb to about 800 kb, about 600 kb to about 700 kb, about 700 kb to about 1,000 kb, about 700 kb to about 900 kb, about 700 kb to about 800 kb, about 800 kb to about 1,000 kb, about 800 kb to about 900 kb, or about 900 kb to about 1,000 kb.

In some embodiments, the artificial chromosome(s) is a bacterial artificial chromosome (BAC) and can have a total number of nucleotides of up to 750 kb. In some embodiments, the artificial chromosome(s) is a BAC and can have a total number of nucleotides in the range of about 100 kb to about 750 kb, about 100 kb to about 700 kb, about 100 kb to about 600 kb, about 100 kb to about 500 kb, about 100 kb to about 400 kb, about 100 kb to about 300 kb, about 100 kb to about 200 kb, about 150 kb to about 750 kb, about 150 kb to about 700 kb, about 150 kb to about 600 kb, about 150 kb to about 500 kb, about 150 kb to about 400 kb, about 150 kb to about 300 kb, about 150 kb to about 200 kb, about 200 kb to about 750 kb, about 200 kb to about 700 kb, about 200 kb to about 600 kb, about 200 kb to about 500 kb, about 200 kb to about 400 kb, about 200 kb to about 300 kb, about 250 kb to about 750 kb, about 250 kb to about 700 kb, about 250 kb to about 600 kb, about 250 kb to about 500 kb, about 250 kb to about 400 kb, about 250 kb to about 300 kb, about 300 kb to about 750 kb, about 300 kb to about 700 kb, about 300 kb to about 600 kb, about 300 kb to about 500 kb, about 300 kb to about 400 kb, about 350 kb to about 750 kb, about 350 kb to about 700 kb, about 350 kb to about 600 kb, about 350 kb to about 500 kb, about 350 kb to about 400 kb, about 400 kb to about 750 kb, about 400 kb to about 700 kb, about 450 kb to about 600 kb, about 450 kb to about 500 kb, about 500 kb to about 750 kb, about 500 kb to about 700 kb, about 500 kb to about 600 kb, about 550 kb to about 750 kb, about 550 kb to about 700 kb, about 550 kb to about 600 kb, about 600 kb to about 750 kb, about 600 kb to about 700 kb, or about 650 kb to about 750 kb.

In some embodiments, the artificial chromosome(s) is a P1-derived artificial chromosome (PAC) and can have a total number of nucleotides of up to 300 kb. In some embodiments, the P1-derived artificial chromosome(s) can have a total number of nucleotides in the range of about 100 kb to about 300 kb, about 100 kb to about 200 kb, or about 200 kb to about 300 kb.

In some embodiments, the vector(s) is a viral vector and can have a total number of nucleotides of up to 10 kb. In some embodiments, the viral vector(s) can have a total number of nucleotides in the range of about 1 kb to about 2 kb, 1 kb to about 3 kb, about 1 kb to about 4 kb, about 1 kb to about 5 kb, about 1 kb to about 6 kb, about 1 kb to about 7 kb, about 1 kb to about 8 kb, about 1 kb to about 9 kb, about 1 kb to about 10 kb, about 2 kb to about 3 kb, about 2 kb to about 4 kb, about 2 kb to about 5 kb, about 2 kb to about 6 kb, about 2 kb to about 7 kb, about 2 kb to about 8 kb, about 2 kb to about 9 kb, about 2 kb to about 10 kb, about 3 kb to about 4 kb, about 3 kb to about 5 kb, about 3 kb to about 6 kb, about 3 kb to about 7 kb, about 3 kb to about 8 kb, about 3 kb to about 9 kb, about 3 kb to about 10 kb, about 4 kb to about 5 kb, about 4 kb to about 6 kb, about 4 kb to about 7 kb, about 4 kb to about 8 kb, about 4 kb to about 9 kb, about 4 kb to about 10 kb, about 5 kb to about 6 kb, about 5 kb to about 7 kb, about 5 kb to about 8 kb, about 5 kb to about 9 kb, about 5 kb to about 10 kb, about 6 kb to about 7 kb, about 6 kb to about 8 kb, about 6 kb to about 9 kb, about 6 kb to about 10 kb, about 7 kb to about 8 kb, about 7 kb to about 9 kb, about 7 kb to about 10 kb, about 8 kb to about 9 kb, about 8 kb to about 10 kb, or about 9 kb to about 10 kb.

In some embodiments, the vector(s) is a lentivirus and can have a total number of nucleotides of up to 8 kb. In some examples, the lentivirus(es) can have a total number of nucleotides of about 1 kb to about 2 kb, about 1 kb to about 3 kb, about 1 kb to about 4 kb, about 1 kb to about 5 kb, about 1 kb to about 6 kb, about 1 kb to about 7 kb, about 1 kb to about 8 kb, about 2 kb to about 3 kb, about 2 kb to about 4 kb, about 2 kb to about 5 kb, about 2 kb to about 6 kb, about 2 kb to about 7 kb, about 2 kb to about 8 kb, about 3 kb to about 4 kb, about 3 kb to about 5 kb, about 3 kb to about 6 kb, about 3 kb to about 7 kb, about 3 kb to about 8 kb, about 4 kb to about 5 kb, about 4 kb to about 6 kb, about 4 kb to about 7 kb, about 4 kb to about 8 kb, about 5 kb to about 6 kb, about 5 kb to about 7 kb, about 5 kb to about 8 kb, about 6 kb to about 8 kb, about 6 kb to about 7 kb, or about 7 kb to about 8 kb.

In some embodiments, the vector(s) is an adenovirus and can have a total number of nucleotides of up to 8 kb. In some embodiments, the adenovirus(es) can have a total number of nucleotides in the range of about 1 kb to about 2 kb, about 1 kb to about 3 kb, about 1 kb to about 4 kb, about 1 kb to about 5 kb, about 1 kb to about 6 kb, about 1 kb to about 7 kb, about 1 kb to about 8 kb, about 2 kb to about 3 kb, about 2 kb to about 4 kb, about 2 kb to about 5 kb, about 2 kb to about 6 kb, about 2 kb to about 7 kb, about 2 kb to about 8 kb, about 3 kb to about 4 kb, about 3 kb to about 5 kb, about 3 kb to about 6 kb, about 3 kb to about 7 kb, about 3 kb to about 8 kb, about 4 kb to about 5 kb, about 4 kb to about 6 kb, about 4 kb to about 7 kb, about 4 kb to about 8 kb, about 5 kb to about 6 kb, about 5 kb to about 7 kb, about 5 kb to about 8 kb, about 6 kb to about 7 kb, about 6 kb to about 8 kb, or about 7 kb to about 8 kb.

In some embodiments, the vector(s) is an adeno-associated virus (AAV vector) and can include a total number of nucleotides of up to 5 kb. In some embodiments, the AAV vector(s) can include a total number of nucleotides in the range of about 1 kb to about 2 kb, about 1 kb to about 3 kb, about 1 kb to about 4 kb, about 1 kb to about 5 kb, about 2 kb to about 3 kb, about 2 kb to about 4 kb, about 2 kb to about 5 kb, about 3 kb to about 4 kb, about 3 kb to about 5 kb, or about 4 kb to about 5 kb.

In some embodiments, the vector(s) is a Gateway® vector and can include a total number of nucleotides of up to 5 kb.

In some embodiments, each Gateway® vector(s) includes a total number of nucleotides in the range of about 1 kb to about 2 kb, about 1 kb to about 3 kb, about 1 kb to about 4 kb, about 1 kb to about 5 kb, about 2 kb to about 3 kb, about 2 kb to about 4 kb, about 2 kb to about 5 kb, about 3 kb to about 4 kb, about 3 kb to about 5 kb, or about 4 kb to about 5 kb.

In some embodiments of any of the compositions, kits, and methods provided herein, the at least two different vectors can be substantially the same type of vector and may differ in size. In some embodiments, the at least two different vectors can be different types of vector, and may have substantially the same size or have different sizes.

In some embodiments, any of the at least two vectors can have a total number of nucleotides in the range of about 500 nucleotides to about 10,000 nucleotides, about 500 nucleotides to about 9,500 nucleotides, about 500 nucleotides to about 9,000 nucleotides, about 500 nucleotides to about 8,500 nucleotides, about 500 nucleotides to about 8,000 nucleotides, about 500 nucleotides to about 7,800 nucleotides, about 500 nucleotides to about 7,600 nucleotides, about 500 nucleotides to about 7,400 nucleotides, about 500 nucleotides to about 7,200 nucleotides, about 500 nucleotides to about 7,000 nucleotides, about 500 nucleotides to about 6,800 nucleotides, about 500 nucleotides to about 6,600 nucleotides, about 500 nucleotides to about 6,400 nucleotides, about 500 nucleotides to about 6,200 nucleotides, about 500 nucleotides to about 6,000 nucleotides, about 500 nucleotides to about 5,800 nucleotides, about 500 nucleotides to about 5,600 nucleotides, about 500 nucleotides to about 5,400 nucleotides, about 500 nucleotides to about 5,200 nucleotides, about 500 nucleotides to about 5,000 nucleotides, about 500 nucleotides to about 4,800 nucleotides, about 4,600 nucleotides, about 500 nucleotides to about 4,400 nucleotides, about 500 nucleotides to about 4,200 nucleotides, about 500 nucleotides to about 4,000 nucleotides, about 500 nucleotides to about 3,800 nucleotides, about 500 nucleotides to about 3,600 nucleotides, about 500 nucleotides to about 3,400 nucleotides, about 500 nucleotides to about 3,200 nucleotides, about 500 nucleotides to about 3,000 nucleotides, about 500 nucleotides to about 2,800 nucleotides, about 500 nucleotides to about 2,600 nucleotides, about 500 nucleotides to about 2,400 nucleotides, about 500 nucleotides to about 2,200 nucleotides, about 500 nucleotides to about 2,000 nucleotides, about 500 nucleotides to about 1,800 nucleotides, about 500 nucleotides to about 1,600 nucleotides, about 500 nucleotides to about 1,400 nucleotides, about 500 nucleotides to about 1,200 nucleotides, about 500 nucleotides to about 1,000 nucleotides, about 500 nucleotides to about 800 nucleotides, about 800 nucleotides to about 10,000 nucleotides, about 800 nucleotides to about 9,500 nucleotides, about 800 nucleotides to about 9,000 nucleotides, about 800 nucleotides to about 8,500 nucleotides, about 800 nucleotides to about 8,000 nucleotides, about 800 nucleotides to about 7,800 nucleotides, about 800 nucleotides to about 7,600 nucleotides, about 800 nucleotides to about 7,400 nucleotides, about 800 nucleotides to about 7,200 nucleotides, about 800 nucleotides to about 7,000 nucleotides, about 800 nucleotides to about 6,800 nucleotides, about 800 nucleotides to about 6,600 nucleotides, about 800 nucleotides to about 6,400 nucleotides, about 800 nucleotides to about 6,200 nucleotides, about 800 nucleotides to about 6,000 nucleotides, about 800 nucleotides to about 5,800 nucleotides, about 800 nucleotides to about 5,600 nucleotides, about 800 nucleotides to about 5,400 nucleotides, about 800 nucleotides to about 5,200 nucleotides, about 800 nucleotides to about 5,000 nucleotides, about 800 nucleotides to about 4,800 nucleotides, about 800 nucleotides to about 4,600 nucleotides, about 800 nucleotides to about 4,400 nucleotides, about 800 nucleotides to about 4,200 nucleotides, about 800 nucleotides to about 4,000 nucleotides, about 800 nucleotides to about 3,800 nucleotides, about 800 nucleotides to about 3,600 nucleotides, about 800 nucleotides to about 3,400 nucleotides, about 800 nucleotides to about 3,200 nucleotides, about 800 nucleotides to about 3,000 nucleotides, about 800 nucleotides to about 2,800 nucleotides, about 800 nucleotides to about 2,600 nucleotides, about 800 nucleotides to about 2,400 nucleotides, about 800 nucleotides to about 2,200 nucleotides, about 800 nucleotides to about 2,000 nucleotides, about 800 nucleotides to about 1,800 nucleotides, about 800 nucleotides to about 1,600 nucleotides, about 800 nucleotides to about 1,400 nucleotides, about 800 nucleotides to about 1,200 nucleotides, about 800 nucleotides to about 1,000 nucleotides, about 1,000 nucleotides to about 10,000 nucleotides, about 1,000 nucleotides to about 9,000 nucleotides, about 1,000 nucleotides to about 8,500 nucleotides, about 1,000 nucleotides to about 8,000 nucleotides, about 1,000 nucleotides to about 7,800 nucleotides, about 1,000 nucleotides to about 7,600 nucleotides, about 1,000 nucleotides to about 7,400 nucleotides, about 1,000 nucleotides to about 7,200 nucleotides, about 1,000 nucleotides to about 7,000 nucleotides, about 1,000 nucleotides to about 6,800 nucleotides, about 1,000 nucleotides to about 6,600 nucleotides, about 1,000 nucleotides to about 6,400 nucleotides, about 1,000 nucleotides to about 6,200 nucleotides, about 1,000 nucleotides to about 6,000 nucleotides, about 1,000 nucleotides to about 5,800 nucleotides, about 1,000 nucleotides to about 5,600 nucleotides, about 1,000 nucleotides to about 5,400 nucleotides, about 1,000 nucleotides to about 5,200 nucleotides, about 1,000 nucleotides to about 5,000 nucleotides, about 1,000 nucleotides to about 4,800 nucleotides, about 1,000 nucleotides to about 4,600 nucleotides, about 1,000 nucleotides to about 4,400 nucleotides, about 1,000 nucleotides to about 4,200 nucleotides, about 1,000 nucleotides to about 4,000 nucleotides, about 1,000 nucleotides to about 3,800 nucleotides, about 1,000 nucleotides to about 3,600 nucleotides, about 1,000 nucleotides to about 3,400 nucleotides, about 1,000 nucleotides to about 3,200 nucleotides, about 1,000 nucleotides to about 3,000 nucleotides, about 1,000 nucleotides to about 2,600 nucleotides, about 1,000 nucleotides to about 2,400 nucleotides, about 1,000 nucleotides to about 2,200 nucleotides, about 1,000 nucleotides to about 2,000 nucleotides, about 1,000 nucleotides to about 1,800 nucleotides, about 1,000 nucleotides to about 1,600 nucleotides, about 1,000 nucleotides to about 1,400 nucleotides, about 1,000 nucleotides to about 1,200 nucleotides, about 1,200 nucleotides to about 10,000 nucleotides, about 1,200 nucleotides to about 9,500 nucleotides, about 1,200 nucleotides to about 9,000 nucleotides, about 1,200 nucleotides to about 8,500 nucleotides, about 1,200 nucleotides to about 8,000 nucleotides, about 1,200 nucleotides to about 7,800 nucleotides, about 1,200 nucleotides to about 7,600 nucleotides, about 1,200 nucleotides to about 7,400 nucleotides, about 1,200 nucleotides to about 7,200 nucleotides, about 1,200 nucleotides to about 7,000 nucleotides, about 1,200 nucleotides to about 6,800 nucleotides, about 1,200 nucleotides to about 6,600 nucleotides, about 1,200 nucleotides to about 6,400 nucleotides, about 1,200 nucleotides to about 6,200 nucleotides, about 1,200 nucleotides to about 6,000 nucleotides, about 1,200 nucleotides to about 5,800 nucleotides, about 1,200 nucleotides to about 5,600 nucleotides, about 1,200 nucleotides to about 5,400 nucleotides, about 1,200 nucleotides to about 5,000 nucleotides, about 1,200 nucleotides to about 4,800 nucleotides, about 1,200 nucleotides to about 4,600 nucleotides, about 1,200 nucleotides to about 4,400 nucleotides, about 1,200 nucleotides to about 4,200 nucleotides, about 1,200 nucleotides to about 4,000 nucleotides, about 1,200 nucleotides to about 3,800 nucleotides, about 1,200 nucleotides to about 3,600 nucleotides, about 1,200 nucleotides to about 3,400 nucleotides, about 1,200 nucleotides to about 3,200 nucleotides, about 1,200 nucleotides to about 3,000 nucleotides, about 1,200 nucleotides to about 2,800 nucleotides, about 1,200 nucleotides to about 2,600 nucleotides, about 1,200 nucleotides to about 2,400 nucleotides, about 1,200 nucleotides to about 2,200 nucleotides, about 1,200 nucleotides to about 2,000 nucleotides, about 1,200 nucleotides to about 1,800 nucleotides, about 1,200 nucleotides to about 1,600 nucleotides, about 1,200 nucleotides to about 1,400 nucleotides, about 1,400 nucleotides to about 10,000 nucleotides, about 1,400 nucleotides to about 9,500 nucleotides, about 1,400 nucleotides to about 9,000 nucleotides, about 1,400 nucleotides to about 8,500 nucleotides, about 1,400 nucleotides to about 8,000 nucleotides, about 1,400 nucleotides to about 7,800 nucleotides, about 1,400 nucleotides to about 7,600 nucleotides, about 1,400 nucleotides to about 7,400 nucleotides, about 1,400 nucleotides to about 7,200 nucleotides, about 1,400 nucleotides to about 7,000 nucleotides, about 1,400 nucleotides to about 6,800 nucleotides, about 1,400 nucleotides to about 6,600 nucleotides, about 1,400 nucleotides to about 6,400 nucleotides, about 1,400 nucleotides to about 6,200 nucleotides, about 1,400 nucleotides to about 6,000 nucleotides, about 1,400 nucleotides to about 5,800 nucleotides, about 1,400 nucleotides to about 5,600 nucleotides, about 1,400 nucleotides to about 5,400 nucleotides, about 1,400 nucleotides to about 5,200 nucleotides, about 1,400 nucleotides to about 5,000 nucleotides, about 1,400 nucleotides to about 4,800 nucleotides, about 1,400 nucleotides to about 4,600 nucleotides, about 1,400 nucleotides to about 4,400 nucleotides, about 1,400 nucleotides to about 4,200 nucleotides, about 1,400 nucleotides to about 4,000 nucleotides, about 1,400 nucleotides to about 3,800 nucleotides, about 1,400 nucleotides to about 3,600 nucleotides, about 1,400 nucleotides to about 3,400 nucleotides, about 1,400 nucleotides to about 3,200 nucleotides, about 1,400 nucleotides to about 3,000 nucleotides, about 1,400 nucleotides to about 2,600 nucleotides, about 1,400 nucleotides to about 2,400 nucleotides, about 1,400 nucleotides to about 2,200 nucleotides, about 1,400 nucleotides to about 2,000 nucleotides, about 1,400 nucleotides to about 1,800 nucleotides, about 1,400 nucleotides to about 1,600 nucleotides, about 1,600 nucleotides to about 10,000 nucleotides, about 1,600 nucleotides to about 9,500 nucleotides, about 1,600 nucleotides to about 9,000 nucleotides, about 1,600 nucleotides to about 8,500 nucleotides, about 1,600 nucleotides to about 8,000 nucleotides, about 1,600 nucleotides to about 7,800 nucleotides, about 1,600 nucleotides to about 7,600 nucleotides, about 1,600 nucleotides to about 7,400 nucleotides, about 1,600 nucleotides to about 7,200 nucleotides, about 1,600 nucleotides to about 7,000 nucleotides, about 1,600 nucleotides to about 6,800 nucleotides, about 1,600 nucleotides to about 6,400 nucleotides, about 1,600 nucleotides to about 6,200 nucleotides, about 1,600 nucleotides to about 6,000 nucleotides, about 1,600 nucleotides to about 5,800 nucleotides, about 1,600 nucleotides to about 5,600 nucleotides, about 1,600 nucleotides to about 5,400 nucleotides, about 1,600 nucleotides to about 5,200 nucleotides, about 1,600 nucleotides to about 5,000 nucleotides, about 1,600 nucleotides to about 4,800 nucleotides, about 1,600 nucleotides to about 4,600 nucleotides, about 1,600 nucleotides to about 4,400 nucleotides, about 1,600 nucleotides to about 4,200 nucleotides, about 1,600 nucleotides to about 4,000 nucleotides, about 1,600 nucleotides to about 3,800 nucleotides, about 1,600 nucleotides to about 3,600 nucleotides, about 1,600 nucleotides to about 3,400 nucleotides, about 1,600 nucleotides to about 3,200 nucleotides, about 1,600 nucleotides to about 3,000 nucleotides, about 1,600 nucleotides to about 2,800 nucleotides, about 1,600 nucleotides to about 2,600 nucleotides, about 1,600 nucleotides to about 2,400 nucleotides, about 1,600 nucleotides to about 2,200 nucleotides, about 1,600 nucleotides to about 2,000 nucleotides, about 1,600 nucleotides to about 1,800 nucleotides, about 1,800 nucleotides to about 10,000 nucleotides, about 1,800 nucleotides to about 9,500 nucleotides, about 1,800 nucleotides to about 9,000 nucleotides, about 1,800 nucleotides to about 8,500 nucleotides, about 1,800 nucleotides to about 8,000 nucleotides, about 1,800 nucleotides to about 7,800 nucleotides, about 1,800 nucleotides to about 7,600 nucleotides, about 1,800 nucleotides to about 7,400 nucleotides, about 1,800 nucleotides to about 7,200 nucleotides, about 1,800 nucleotides to about 7,000 nucleotides, about 1,800 nucleotides to about 6,800 nucleotides, about 1,800 nucleotides to about 6,600 nucleotides, about 1,800 nucleotides to about 6,400 nucleotides, about 1,800 nucleotides to about 6,200 nucleotides, about 1,800 nucleotides to about 6,000 nucleotides, about 1,800 nucleotides to about 5,800 nucleotides, about 1,800 nucleotides to about 5,600 nucleotides, about 1,800 nucleotides to about 5,400 nucleotides, about 1,800 nucleotides to about 5,200 nucleotides, about 1,800 nucleotides to about 5,000 nucleotides, about 1,800 nucleotides to about 4,800 nucleotides, about 1,800 nucleotides to about 4,600 nucleotides, about 1,800 nucleotides to about 4,400 nucleotides, about 1,800 nucleotides to about 4,200 nucleotides, about 1,800 nucleotides to about 4,000 nucleotides, about 1,800 nucleotides to about 3,800 nucleotides, about 1,800 nucleotides to about 3,600 nucleotides, about 1,800 nucleotides to about 3,400 nucleotides, about 1,800 nucleotides to about 3,200 nucleotides, about 1,800 nucleotides to about 3,000 nucleotides, about 1,800 nucleotides to about 2,800 nucleotides, about 1,800 nucleotides to about 2,600 nucleotides, about 1,800 nucleotides to about 2,400 nucleotides, about 1,800 nucleotides to about 2,200 nucleotides, about 1,800 nucleotides to about 2,000 nucleotides, about 2,000 nucleotides to about 10,000 nucleotides, about 2,000 nucleotides to about 9,500 nucleotides, about 2,000 nucleotides to about 9,000 nucleotides, about 2,000 nucleotides to about 8,500 nucleotides, about 2,000 nucleotides to about 8,000 nucleotides, about 2,000 nucleotides to about 7,800 nucleotides, about 2,000 nucleotides to about 7,600 nucleotides, about 2,000 nucleotides to about 7,400 nucleotides, about 2,000 nucleotides to about 7,200 nucleotides, about 2,000 nucleotides to about 7,000 nucleotides, about 2,000 nucleotides to about 6,800 nucleotides, about 2,000 nucleotides to about 6,600 nucleotides, about 2,000 nucleotides to about 6,400 nucleotides, about 2,000 nucleotides to about 6,200 nucleotides, about 2,000 nucleotides to about 6,000 nucleotides, about 2,000 nucleotides to about 5,800 nucleotides, about 2,000 nucleotides to about 5,600 nucleotides, about 2,000 nucleotides to about 5,400 nucleotides, about 2,000 nucleotides to about 5,200 nucleotides, about 2,000 nucleotides to about 5,000 nucleotides, about 2,000 nucleotides to about 4,800 nucleotides, about 2,000 nucleotides to about 4,600 nucleotides, about 2,000 nucleotides to about 4,400 nucleotides, about 2,000 nucleotides to about 4,200 nucleotides, about 2,000 nucleotides to about 4,000 nucleotides, about 2,000 nucleotides to about 3,800 nucleotides, about 2,000 nucleotides to about 3,600 nucleotides, about 2,000 nucleotides to about 3,400 nucleotides, about 2,000 nucleotides to about 3,200 nucleotides, about 2,000 nucleotides to about 3,000 nucleotides, about 2,000 nucleotides to about 2,800 nucleotides, about 2,000 nucleotides to about 2,600 nucleotides, about 2,000 nucleotides to about 2,400 nucleotides, about 2,000 nucleotides to about 2,200 nucleotides, about 2,200 nucleotides to about 10,000 nucleotides, about 9,500 nucleotides, about 9,000 nucleotides, about 8,500 nucleotides, about 8,000 nucleotides, about 7,800 nucleotides, about 7,600 nucleotides, about 7,400 nucleotides, about 7,200 nucleotides, about 7,000 nucleotides, about 6,800 nucleotides, about 6,600 nucleotides, about 6,400 nucleotides, about 6,200 nucleotides, about 6,000 nucleotides, about 5,800 nucleotides, about 5,600 nucleotides, about 5,400 nucleotides, about 5,200 nucleotides, about 5,000 nucleotides, about 4,800 nucleotides, about 4,600 nucleotides, about 4,400 nucleotides, about 4,200 nucleotides, about 4,000 nucleotides, about 3,800 nucleotides, about 3,600 nucleotides, about 3,400 nucleotides, about 3,200 nucleotides, about 3,000 nucleotides, about 2,800 nucleotides, about 2,600 nucleotides, about 2,400 nucleotides, about 2,400 nucleotides to about 10,000 nucleotides, about 2,400 nucleotides to about 9,500 nucleotides, about 2,400 nucleotides to about 9,000 nucleotides, about 2,400 nucleotides to about 8,500 nucleotides, about 2,400 nucleotides to about 8,000 nucleotides, about 2,400 nucleotides to about 7,800 nucleotides, about 2,400 nucleotides to about 7,600 nucleotides, about 2,400 nucleotides to about 7,400 nucleotides, about 2,400 nucleotides to about 7,200 nucleotides, about 2,400 nucleotides to about 7,000 nucleotides, about 2,400 nucleotides to about 6,800 nucleotides, about 2,400 nucleotides to about 6,600 nucleotides, about 2,400 nucleotides to about 6,400 nucleotides, about 2,400 nucleotides to about 6,200 nucleotides, about 2,400 nucleotides to about 6,000 nucleotides, about 2,400 nucleotides to about 5,800 nucleotides, about 2,400 nucleotides to about 5,600 nucleotides, about 2,400 nucleotides to about 5,400 nucleotides, about 21400 nucleotides to about 5,200 nucleotides, about 2,400 nucleotides to about 5,000 nucleotides, about 2,400 nucleotides to about 4,800 nucleotides, about 2,400 nucleotides to about 4,600 nucleotides, about 2,400 nucleotides to about 4,400 nucleotides, about 2,400 nucleotides to about 4,200 nucleotides, about 2,400 nucleotides to about 4,000 nucleotides, about 2,400 nucleotides to about 3,800 nucleotides, about 2,400 nucleotides to about 3,600 nucleotides, about 2,400 nucleotides to about 3,400 nucleotides, about 2,400 nucleotides to about 3,200 nucleotides, about 2,400 nucleotides to about 3,000 nucleotides, about 2,400 nucleotides to about 2,800 nucleotides, about 2,400 nucleotides to about 2,600 nucleotides, about 2,600 nucleotides to about 10,000 nucleotides, about 2,600 nucleotides to about 9,500 nucleotides, about 2,600 nucleotides to about 9,000 nucleotides, about 2,600 nucleotides to about 8,500 nucleotides, about 2,600 nucleotides to about 8,000 nucleotides, about 2,600 nucleotides to about 7,800 nucleotides, about 2,600 nucleotides to about 7,600 nucleotides, about 2,600 nucleotides to about 7,400 nucleotides, about 2,600 nucleotides to about 7,200 nucleotides, about 2,600 nucleotides to about 7,000 nucleotides, about 2,600 nucleotides to about 6,800 nucleotides, about 2,600 nucleotides to about 6,600 nucleotides, about 2,600 nucleotides to about 6,400 nucleotides, about 2,600 nucleotides to about 6,200 nucleotides, about 2,600 nucleotides to about 6,000 nucleotides, about 2,600 nucleotides to about 5,800 nucleotides, about 2,600 nucleotides to about 5,600 nucleotides, about 2,600 nucleotides to about 5,400 nucleotides, about 2,600 nucleotides to about 5,200 nucleotides, about 2,600 nucleotides to about 5,000 nucleotides, about 2,600 nucleotides to about 4,800 nucleotides, about 2,600 nucleotides to about 4,600 nucleotides, about 2,600 nucleotides to about 4,400 nucleotides, about 2,600 nucleotides to about 4,200 nucleotides, about 2,600 nucleotides to about 4,000 nucleotides, about 2,600 nucleotides to about 3,800 nucleotides, about 2,600 nucleotides to about 3,600 nucleotides, about 2,600 nucleotides to about 3,400 nucleotides, about 2,600 nucleotides to about 3,200 nucleotides, about 2,600 nucleotides to about 3,000 nucleotides, about 2,600 nucleotides to about 2,800 nucleotides, about 2,800 nucleotides to about 10,000 nucleotides, about 2,800 nucleotides to about 9,500 nucleotides, about 2,800 nucleotides to about 9,000 nucleotides, about 2,800 nucleotides to about 8,500 nucleotides, about 2,800 nucleotides to about 8,000 nucleotides, about 2,800 nucleotides to about 7,800 nucleotides, about 2,800 nucleotides to about 7,600 nucleotides, about 2,800 nucleotides to about 7,400 nucleotides, about 2,800 nucleotides to about 7,200 nucleotides, about 2,800 nucleotides to about 7,000 nucleotides, about 2,800 nucleotides to about 6,800 nucleotides, about 2,800 nucleotides to about 6,600 nucleotides, about 2,800 nucleotides to about 6,400 nucleotides, about 2,800 nucleotides to about 6,200 nucleotides, about 2,800 nucleotides to about 6,000 nucleotides, about 2,800 nucleotides to about 5,800 nucleotides, about 2,800 nucleotides to about 5,600 nucleotides, about 2,800 nucleotides to about 5,400 nucleotides, about 2,800 nucleotides to about 5,200 nucleotides, about 2,800 nucleotides to about 5,000 nucleotides, about 2,800 nucleotides to about 4,800 nucleotides, about 2,800 nucleotides to about 4,600 nucleotides, about 2,800 nucleotides to about 4,400 nucleotides, about 2,800 nucleotides to about 4,200 nucleotides, about 2,800 nucleotides to about 4,000 nucleotides, about 2,800 nucleotides to about 3,800 nucleotides, about 2,800 nucleotides to about 3,600 nucleotides, about 2,800 nucleotides to about 3,400 nucleotides, about 2,800 nucleotides to about 3,200 nucleotides, about 2,800 nucleotides to about 3,000 nucleotides, about 3,000 nucleotides to about 10,000 nucleotides, about 3,000 nucleotides to about 9,500 nucleotides, about 3,000 nucleotides to about 9,000 nucleotides, about 3,000 nucleotides to about 8,500 nucleotides, about 3,000 nucleotides to about 8,000 nucleotides, about 3,000 nucleotides to about 7,800 nucleotides, about 3,000 nucleotides to about 7,600 nucleotides, about 3,000 nucleotides to about 7,400 nucleotides, about 3,000 nucleotides to about 7,200 nucleotides, about 3,000 nucleotides to about 7,000 nucleotides, about 3,000 nucleotides to about 6,800 nucleotides, about 3,000 nucleotides to about 6,600 nucleotides, about 3,000 nucleotides to about 6,400 nucleotides, about 3,000 nucleotides to about 6,200 nucleotides, about 3,000 nucleotides to about 6,000 nucleotides, about 3,000 nucleotides to about 5,800 nucleotides, about 3,000 nucleotides to about 5,600 nucleotides, about 3,000 nucleotides to about 5,400 nucleotides, about 3,000 nucleotides to about 5,200 nucleotides, about 3,000 nucleotides to about 5,000 nucleotides, about 3,000 nucleotides to about 4,800 nucleotides, about 3,000 nucleotides to about 4,600 nucleotides, about 3,000 nucleotides to about 4,400 nucleotides, about 3,000 nucleotides to about 4,200 nucleotides, about 3,000 nucleotides to about 4,000 nucleotides, about 3,000 nucleotides to about 3,800 nucleotides, about 3,000 nucleotides to about 3,600 nucleotides, about 3,000 nucleotides to about 3,400 nucleotides, about 3,000 nucleotides to about 3,200 nucleotides, about 3,200 nucleotides to about 10,000 nucleotides, about 3,200 nucleotides to about 9,500 nucleotides, about 3,200 nucleotides to about 9,000 nucleotides, about 3,200 nucleotides to about 8,500 nucleotides, about 3,200 nucleotides to about 8,000 nucleotides, about 3,200 nucleotides to about 7,800 nucleotides, about 3,200 nucleotides to about 7,600 nucleotides, about 3,200 nucleotides to about 7,400 nucleotides, about 3,200 nucleotides to about 7,200 nucleotides, about 3,200 nucleotides to about 7,000 nucleotides, about 3,200 nucleotides to about 6,800 nucleotides, about 3,200 nucleotides to about 6,600 nucleotides, about 3,200 nucleotides to about 6,400 nucleotides, about 3,200 nucleotides to about 6,200 nucleotides, about 3,200 nucleotides to about 6,000 nucleotides, about 3,200 nucleotides to about 5,800 nucleotides, about 3,200 nucleotides to about 5,600 nucleotides, about 3,200 nucleotides to about 5,400 nucleotides, about 3,200 nucleotides to about 5,200 nucleotides, about 3,200 nucleotides to about 5,000 nucleotides, about 3,200 nucleotides to about 4,800 nucleotides, about 3,200 nucleotides to about 4,600 nucleotides, about 3,200 nucleotides to about 4,400 nucleotides, about 3,200 nucleotides to about 4,200 nucleotides, about 3,200 nucleotides to about 4,000 nucleotides, about 3,200 nucleotides to about 3,800 nucleotides, about 3,200 nucleotides to about 3,600 nucleotides, about 3,200 nucleotides to about 3,400 nucleotides, about 3,400 nucleotides to about 10,000 nucleotides, about 3,400 nucleotides to about 9,500 nucleotides, about 3,400 nucleotides to about 9,000 nucleotides, about 3,400 nucleotides to about 8,500 nucleotides, about 3,400 nucleotides to about 8,000 nucleotides, about 3,400 nucleotides to about 7,800 nucleotides, about 3,400 nucleotides to about 7,600 nucleotides, about 3,400 nucleotides to about 7,400 nucleotides, about 3,400 nucleotides to about 7,200 nucleotides, about 3,400 nucleotides to about 7,000 nucleotides, about 3,400 nucleotides to about 6,800 nucleotides, about 3,400 nucleotides to about 6,600 nucleotides, about 3,400 nucleotides to about 6,400 nucleotides, about 3,400 nucleotides to about 6,200 nucleotides, about 3,400 nucleotides to about 6,000 nucleotides, about 3,400 nucleotides to about 5,800 nucleotides, about 3,400 nucleotides to about 5,600 nucleotides, about 3,400 nucleotides to about 5,400 nucleotides, about 3,400 nucleotides to about 5,200 nucleotides, about 3,400 nucleotides to about 5,000 nucleotides, about 3,400 nucleotides to about 4,800 nucleotides, about 3,400 nucleotides to about 4,600 nucleotides, about 3,400 nucleotides to about 4,400 nucleotides, about 3,400 nucleotides to about 4,200 nucleotides, about 3,400 nucleotides to about 4,000 nucleotides, about 3,400 nucleotides to about 3,800 nucleotides, about 3,400 nucleotides to about 3,600 nucleotides, about 3,600 nucleotides to about 10,000 nucleotides, about 3,600 nucleotides to about 9,500 nucleotides, about 3,600 nucleotides to about 9,000 nucleotides, about 3,600 nucleotides to about 8,500 nucleotides, about 3,600 nucleotides to about 8,000 nucleotides, about 3,600 nucleotides to about 7,800 nucleotides, about 3,600 nucleotides to about 7,600 nucleotides, about 3,600 nucleotides to about 7,400 nucleotides, about 3,600 nucleotides to about 7,200 nucleotides, about 3,600 nucleotides to about 7,000 nucleotides, about 3,600 nucleotides to about 6,800 nucleotides, about 3,600 nucleotides to about 6,600 nucleotides, about 3,600 nucleotides to about 6,400 nucleotides, about 3,600 nucleotides to about 6,200 nucleotides, about 3,600 nucleotides to about 6,000 nucleotides, about 3,600 nucleotides to about 5,800 nucleotides, about 3,600 nucleotides to about 5,600 nucleotides, about 3,600 nucleotides to about 5,400 nucleotides, about 3,600 nucleotides to about 5,200 nucleotides, about 3,600 nucleotides to about 5,000 nucleotides, about 3,600 nucleotides to about 4,800 nucleotides, about 3,600 nucleotides to about 4,600 nucleotides, about 3,600 nucleotides to about 4,400 nucleotides, about 3,600 nucleotides to about 4,200 nucleotides, about 3,600 nucleotides to about 4,000 nucleotides, about 3,600 nucleotides to about 3,800 nucleotides, about 3,800 nucleotides to about 10,000 nucleotides, about 3,800 nucleotides to about 9,500 nucleotides, about 3,800 nucleotides to about 9,000 nucleotides, about 3,800 nucleotides to about 8,500 nucleotides, about 3,800 nucleotides to about 8,000 nucleotides, about 3,800 nucleotides to about 7,800 nucleotides, about 3,800 nucleotides to about 7,600 nucleotides, about 3,800 nucleotides to about 7,400 nucleotides, about 3,800 nucleotides to about 7,200 nucleotides, about 3,800 nucleotides to about 7,000 nucleotides, about 3,800 nucleotides to about 6,800 nucleotides, about 3,800 nucleotides to about 6,600 nucleotides, about 3,800 nucleotides to about 6,400 nucleotides, about 3,800 nucleotides to about 6,200 nucleotides, about 3,800 nucleotides to about 6,000 nucleotides, about 3,800 nucleotides to about 5,800 nucleotides, about 3,800 nucleotides to about 5,600 nucleotides, about 3,800 nucleotides to about 5,400 nucleotides, about 3,800 nucleotides to about 5,200 nucleotides, about 3,800 nucleotides to about 5,000 nucleotides, about 3,800 nucleotides to about 4,800 nucleotides, about 3,800 nucleotides to about 4,600 nucleotides, about 3,800 nucleotides to about 4,200 nucleotides, about 3,800 nucleotides to about 4,000 nucleotides, about 4,000 nucleotides to about 10,000 nucleotides, about 4,000 nucleotides to about 9,500 nucleotides, about 4,000 nucleotides to about 9,000 nucleotides, about 4,000 nucleotides to about 8,500 nucleotides, about 4,000 nucleotides to about 8,000 nucleotides, about 4,000 nucleotides to about 7,800 nucleotides, about 4,000 nucleotides to about 7,600 nucleotides, about 4,000 nucleotides to about 7,400 nucleotides, about 4,000 nucleotides to about 7,200 nucleotides, about 4,000 nucleotides to about 7,000 nucleotides, about 4,000 nucleotides to about 6,800 nucleotides, about 4,000 nucleotides to about 6,600 nucleotides, about 4,000 nucleotides to about 6,400 nucleotides, about 4,000 nucleotides to about 6,200 nucleotides, about 4,000 nucleotides to about 6,000 nucleotides, about 4,000 nucleotides to about 5,800 nucleotides, about 4,000 nucleotides to about 5,600 nucleotides, about 4,000 nucleotides to about 5,400 nucleotides, about 4,000 nucleotides to about 5,200 nucleotides, about 4,000 nucleotides to about 5,000 nucleotides, about 4,000 nucleotides to about 4,800 nucleotides, about 4,000 nucleotides to about 4,600 nucleotides, about 4,000 nucleotides to about 4,400 nucleotides, about 4,000 nucleotides to about 4,200 nucleotides, about 4,200 nucleotides to about 10,000 nucleotides, about 4,200 nucleotides to about 9,500 nucleotides, about 4,200 nucleotides to about 9,000 nucleotides, about 4,200 nucleotides to about 8,500 nucleotides, about 4,200 nucleotides to about 8,000 nucleotides, about 4,200 nucleotides to about 7,800 nucleotides, about 4,200 nucleotides to about 7,600 nucleotides, about 4,200 nucleotides to about 7,400 nucleotides, about 4,200 nucleotides to about 7,200 nucleotides, about 4,200 nucleotides to about 7,000 nucleotides, about 4,200 nucleotides to about 6,800 nucleotides, about 4,200 nucleotides to about 6,600 nucleotides, about 4,200 nucleotides to about 6,400 nucleotides, about 4,200 nucleotides to about 6,200 nucleotides, about 4,200 nucleotides to about 6,000 nucleotides, about 4,200 nucleotides to about 5,800 nucleotides, about 4,200 nucleotides to about 5,600 nucleotides, about 4,200 nucleotides to about 5,400 nucleotides, about 4,200 nucleotides to about 5,200 nucleotides, about 4,200 nucleotides to about 5,000 nucleotides, about 4,200 nucleotides to about 4,800 nucleotides, about 4,200 nucleotides to about 4,600 nucleotides, about 4,200 nucleotides to about 4,400 nucleotides, about 4,400 nucleotides to about 10,000 nucleotides, about 4,400 nucleotides to about 9,500 nucleotides, about 4,400 nucleotides to about 9,000 nucleotides, about 4,400 nucleotides to about 8,500 nucleotides, about 4,400 nucleotides to about 8,000 nucleotides, about 4,400 nucleotides to about 7,800 nucleotides, about 4,400 nucleotides to about 7,600 nucleotides, about 4,400 nucleotides to about 7,400 nucleotides, about 4,400 nucleotides to about 7,200 nucleotides, about 4,400 nucleotides to about 7,000 nucleotides, about 4,400 nucleotides to about 6,800 nucleotides, about 4,400 nucleotides to about 6,600 nucleotides, about 4,400 nucleotides to about 6,400 nucleotides, about 4,400 nucleotides to about 6,200 nucleotides, about 4,400 nucleotides to about 6,000 nucleotides, about 4,400 nucleotides to about 5,800 nucleotides, about 4,400 nucleotides to about 5,600 nucleotides, about 4,400 nucleotides to about 5,400 nucleotides, about 4,400 nucleotides to about 5,200 nucleotides, about 4,400 nucleotides to about 5,000 nucleotides, about 4,400 nucleotides to about 4,800 nucleotides, about 4,400 nucleotides to about 4,600 nucleotides, about 4,600 nucleotides to about 10,000 nucleotides, about 4,600 nucleotides to about 9,500 nucleotides, about 4,600 nucleotides to about 9,000 nucleotides, about 4,600 nucleotides to about 8,500 nucleotides, about 4,600 nucleotides to about 8,000 nucleotides, about 4,600 nucleotides to about 7,800 nucleotides, about 4,600 nucleotides to about 7,600 nucleotides, about 4,600 nucleotides to about 7,400 nucleotides, about 4,600 nucleotides to about 7,200 nucleotides, about 4,600 nucleotides to about 7,000 nucleotides, about 4,600 nucleotides to about 6,800 nucleotides, about 4,600 nucleotides to about 6,600 nucleotides, about 4,600 nucleotides to about 6,400 nucleotides, about 4,600 nucleotides to about 6,200 nucleotides, about 4,600 nucleotides to about 6,000 nucleotides, about 4,600 nucleotides to about 5,800 nucleotides, about 4,600 nucleotides to about 5,600 nucleotides, about 4,600 nucleotides to about 5,400 nucleotides, about 4,600 nucleotides to about 5,200 nucleotides, about 4,600 nucleotides to about 5,000 nucleotides, about 4,600 nucleotides to about 4,800 nucleotides, about 4,800 nucleotides to about 10,000 nucleotides, about 4,800 nucleotides to about 9,500 nucleotides, about 4,800 nucleotides to about 9,000 nucleotides, about 4,800 nucleotides to about 8,500 nucleotides, about 4,800 nucleotides to about 8,000 nucleotides, about 4,800 nucleotides to about 7,800 nucleotides, about 4,800 nucleotides to about 7,600 nucleotides, about 4,800 nucleotides to about 7,400 nucleotides, about 4,800 nucleotides to about 7,200 nucleotides, about 4,800 nucleotides to about 7,000 nucleotides, about 4,800 nucleotides to about 6,800 nucleotides, about 4,800 nucleotides to about 6,600 nucleotides, about 4,800 nucleotides to about 6,400 nucleotides, about 4,800 nucleotides to about 6,200 nucleotides, about 4,800 nucleotides to about 6,000 nucleotides, about 4,800 nucleotides to about 5,800 nucleotides, about 4,800 nucleotides to about 5,600 nucleotides, about 4,800 nucleotides to about 5,400 nucleotides, about 4,800 nucleotides to about 5,200 nucleotides, about 4,800 nucleotides to about 5,000 nucleotides, about 5,000 nucleotides to about 10,000 nucleotides, about 5,000 nucleotides to about 9,500 nucleotides, about 5,000 nucleotides to about 9,000 nucleotides, about 5,000 nucleotides to about 8,500 nucleotides, about 5,000 nucleotides to about 8,000 nucleotides, about 5,000 nucleotides to about 7,800 nucleotides, about 5,000 nucleotides to about 7,600 nucleotides, about 5,000 nucleotides to about 7,400 nucleotides, about 5,000 nucleotides to about 7,200 nucleotides, about 5,000 nucleotides to about 7,000 nucleotides, about 5,000 nucleotides to about 6,800 nucleotides, about 5,000 nucleotides to about 6,600 nucleotides, about 5,000 nucleotides to about 6,400 nucleotides, about 5,000 nucleotides to about 6,200 nucleotides, about 5,000 nucleotides to about 6,000 nucleotides, about 5,000 nucleotides to about 5,800 nucleotides, about 5,000 nucleotides to about 5,600 nucleotides, about 5,000 nucleotides to about 5,400 nucleotides, about 5,000 nucleotides to about 5,200 nucleotides, about 5,200 nucleotides to about 10,000 nucleotides, about 5,200 nucleotides to about 9,500 nucleotides, about 5,200 nucleotides to about 9,000 nucleotides, about 5,200 nucleotides to about 8,500 nucleotides, about 5,200 nucleotides to about 8,000 nucleotides, about 5,200 nucleotides to about 7,800 nucleotides, about 5,200 nucleotides to about 7,600 nucleotides, about 5,200 nucleotides to about 7,400 nucleotides, about 5,200 nucleotides to about 7,200 nucleotides, about 5,200 nucleotides to about 7,000 nucleotides, about 5,200 nucleotides to about 6,800 nucleotides, about 5,200 nucleotides to about 6,600 nucleotides, about 5,200 nucleotides to about 6,400 nucleotides, about 5,200 nucleotides to about 6,200 nucleotides, about 5,200 nucleotides to about 6,000 nucleotides, about 5,200 nucleotides to about 5,800 nucleotides, about 5,200 nucleotides to about 5,600 nucleotides, about 5,200 nucleotides to about 5,400 nucleotides, about 5,400 nucleotides to about 10,000 nucleotides, about 5,400 nucleotides to about 9,500 nucleotides, about 5,400 nucleotides to about 9,000 nucleotides, about 5,400 nucleotides to about 8,500 nucleotides, about 5,400 nucleotides to about 8,000 nucleotides, about 5,400 nucleotides to about 7,800 nucleotides, about 5,400 nucleotides to about 7,600 nucleotides, about 5,400 nucleotides to about 7,400 nucleotides, about 5,400 nucleotides to about 7,200 nucleotides, about 5,400 nucleotides to about 7,000 nucleotides, about 5,400 nucleotides to about 6,800 nucleotides, about 5,400 nucleotides to about 6,600 nucleotides, about 5,400 nucleotides to about 6,400 nucleotides, about 5,400 nucleotides to about 6,200 nucleotides, about 5,400 nucleotides to about 6,000 nucleotides, about 5,400 nucleotides to about 5,800 nucleotides, about 5,400 nucleotides to about 5,600 nucleotides, about 5,600 nucleotides to about 10,000 nucleotides, about 5,600 nucleotides to about 9,500 nucleotides, about 5,600 nucleotides to about 9,000 nucleotides, about 5,600 nucleotides to about 8,500 nucleotides, about 5,600 nucleotides to about 8,000 nucleotides, about 5,600 nucleotides to about 7,800 nucleotides, about 5,600 nucleotides to about 7,600 nucleotides, about 5,600 nucleotides to about 7,400 nucleotides, about 5,600 nucleotides to about 7,200 nucleotides, about 5,600 nucleotides to about 7,000 nucleotides, about 5,600 nucleotides to about 6,800 nucleotides, about 5,600 nucleotides to about 6,600 nucleotides, about 5,600 nucleotides to about 6,400 nucleotides, about 5,600 nucleotides to about 6,200 nucleotides, about 5,600 nucleotides to about 6,000 nucleotides, about 5,600 nucleotides to about 5,800 nucleotides, about 5,800 nucleotides to about 10,000 nucleotides, about 5,800 nucleotides to about 9,500 nucleotides, about 5,800 nucleotides to about 9,000 nucleotides, about 5,800 nucleotides to about 8,500 nucleotides, about 5,800 nucleotides to about 8,000 nucleotides, about 5,800 nucleotides to about 7,800 nucleotides, about 5,800 nucleotides to about 7,600 nucleotides, about 5,800 nucleotides to about 7,400 nucleotides, about 5,800 nucleotides to about 7,200 nucleotides, about 5,800 nucleotides to about 7,000 nucleotides, about 5,800 nucleotides to about 6,800 nucleotides, about 5,800 nucleotides to about 6,600 nucleotides, about 5,800 nucleotides to about 6,400 nucleotides, about 5,800 nucleotides to about 6,200 nucleotides, about 5,800 nucleotides to about 6,000 nucleotides, about 6,000 nucleotides to about 10,000 nucleotides, about 6,000 nucleotides to about 9,500 nucleotides, about 6,000 nucleotides to about 9,000 nucleotides, about 6,000 nucleotides to about 8,500 nucleotides, about 6,000 nucleotides to about 8,000 nucleotides, about 6,000 nucleotides to about 7,800 nucleotides, about 6,000 nucleotides to about 7,600 nucleotides, about 6,000 nucleotides to about 7,400 nucleotides, about 6,000 nucleotides to about 7,200 nucleotides, about 6,000 nucleotides to about 7,000 nucleotides, about 6,000 nucleotides to about 6,800 nucleotides, about 6,000 nucleotides to about 6,600 nucleotides, about 6,000 nucleotides to about 6,400 nucleotides, about 6,000 nucleotides to about 6,200 nucleotides, about 6,200 nucleotides to about 10,000 nucleotides, about 6,200 nucleotides to about 9,000 nucleotides, about 6,200 nucleotides to about 8,500 nucleotides, about 6,200 nucleotides to about 8,000 nucleotides, about 6,200 nucleotides to about 7,800 nucleotides, about 6,200 nucleotides to about 7,600 nucleotides, about 6,200 nucleotides to about 7,400 nucleotides, about 6,200 nucleotides to about 7,200 nucleotides, about 6,200 nucleotides to about 7,000 nucleotides, about 6,200 nucleotides to about 6,800 nucleotides, about 6,200 nucleotides to about 6,600 nucleotides, about 6,200 nucleotides to about 6,400 nucleotides, about 6,400 nucleotides to about 10,000 nucleotides, about 6,400 nucleotides to about 9,500 nucleotides, about 6,400 nucleotides to about 9,000 nucleotides, about 6,400 nucleotides to about 8,500 nucleotides, about 6,400 nucleotides to about 8,000 nucleotides, about 6,400 nucleotides to about 7,800 nucleotides, about 6,400 nucleotides to about 7,600 nucleotides, about 6,400 nucleotides to about 7,400 nucleotides, about 6,400 nucleotides to about 7,200 nucleotides, about 6,400 nucleotides to about 7,000 nucleotides, about 6,400 nucleotides to about 6,800 nucleotides, about 6,400 nucleotides to about 6,600 nucleotides, about 6,600 nucleotides to about 10,000 nucleotides, about 6,600 nucleotides to about 9,500 nucleotides, about 6,600 nucleotides to about 9,000 nucleotides, about 6,600 nucleotides to about 8,500 nucleotides, about 6,600 nucleotides to about 8,000 nucleotides, about 6,600 nucleotides to about 7,800 nucleotides, about 6,600 nucleotides to about 7,600 nucleotides, about 6,600 nucleotides to about 7,400 nucleotides, about 6,600 nucleotides to about 7,200 nucleotides, about 6,600 nucleotides to about 7,000 nucleotides, about 6,600 nucleotides to about 6,800 nucleotides, about 6,800 nucleotides to about 10,000 nucleotides, about 6,800 nucleotides to about 9,500 nucleotides, about 6,800 nucleotides to about 9,000 nucleotides, about 6,800 nucleotides to about 8,500 nucleotides, about 6,800 nucleotides to about 8,000 nucleotides, about 6,800 nucleotides to about 7,800 nucleotides, about 6,800 nucleotides to about 7,600 nucleotides, about 6,800 nucleotides to about 7,400 nucleotides, about 6,800 nucleotides to about 7,200 nucleotides, about 6,800 nucleotides to about 7,000 nucleotides, about 7,000 nucleotides to about 10,000 nucleotides, about 7,000 nucleotides to about 9,500 nucleotides, about 7,000 nucleotides to about 9,000 nucleotides, about 7,000 nucleotides to about 8,500 nucleotides, about 7,000 nucleotides to about 8,000 nucleotides, about 7,000 nucleotides to about 7,800 nucleotides, about 7,000 nucleotides to about 7,600 nucleotides, about 7,000 nucleotides to about 7,400 nucleotides, about 7,000 nucleotides to about 7,200 nucleotides, about 7,200 nucleotides to about 10,000 nucleotides, about 7,200 nucleotides to about 9,500 nucleotides, about 7,200 nucleotides to about 9,000 nucleotides, about 7,200 nucleotides to about 8,500 nucleotides, about 7,200 nucleotides to about 8,000 nucleotides, about 7,200 nucleotides to about 7,800 nucleotides, about 7,200 nucleotides to about 7,600 nucleotides, about 7,200 nucleotides to about 7,400 nucleotides, about 7,400 nucleotides to about 10,000 nucleotides, about 7,400 nucleotides to about 9,500 nucleotides, about 7,400 nucleotides to about 9,000 nucleotides, about 7,400 nucleotides to about 8,500 nucleotides, about 7,400 nucleotides to about 8,000 nucleotides, about 7,400 nucleotides to about 7,800 nucleotides, about 7,400 nucleotides to about 7,600 nucleotides, about 7,600 nucleotides to about 10,000 nucleotides, about 7,600 nucleotides to about 9,500 nucleotides, about 7,600 nucleotides to about 9,000 nucleotides, about 7,600 nucleotides to about 8,500 nucleotides, about 7,600 nucleotides to about 8,000 nucleotides, about 7,600 nucleotides to about 7,800 nucleotides, about 7,800 nucleotides to about 10,000 nucleotides, about 7,800 nucleotides to about 9,500 nucleotides, about 7,800 nucleotides to about 9,000 nucleotides, about 7,800 nucleotides to about 8,500 nucleotides, about 7,800 nucleotides to about 8,000 nucleotides, about 8,000 nucleotides to about 10,000 nucleotides, about 8,000 nucleotides to about 9,500 nucleotides, about 8,000 nucleotides to about 9,000 nucleotides, about 8,000 nucleotides to about 8,500 nucleotides, about 8,500 nucleotides to about 10,000 nucleotides, about 8,500 nucleotides to about 9,500 nucleotides, about 8,500 nucleotides to about 9,000 nucleotides, about 9,000 nucleotides to about 10,000 nucleotides, about 9,000 nucleotides to about 9,500 nucleotides, or about 9,500 nucleotides to about 10,000 nucleotides (inclusive).

A variety of different methods known in the art can be used to introduce any of the vectors disclosed herein into a mammalian cell (e.g., a cochlear inner hair cell). Non-limiting examples of methods for introducing nucleic acid into a mammalian cell include: lipofection, transfection (e.g., calcium phosphate transfection, transfection using highly branched organic compounds, transfection using cationic polymers, dendrimer-based transfection, optical transfection, particle-based transfection (e.g., nanoparticle transfection), or transfection using liposomes (e.g., cationic liposomes)), microinjection, electroporation, cell squeezing, sonoporation, protoplast fusion, impalefection, hydrodynamic delivery, gene gun, magnetofection, viral transfection, and nucleofection.

Skilled practitioners will appreciate that any of the vectors described herein can be introduced into a mammalian cell by, for example, lipofection.

Various molecular biology techniques that can be used to introduce a mutation(s) and/or a deletion(s) into an endogenous gene are also known in the art. Non-limiting examples of such techniques include site-directed mutagenesis, CRISPR (e.g., CRISPR/Cas9-induced knock-in mutations and CRISPR/Cas9-induced knock-out mutations), and TALENs. These methods can be used to correct the sequence of a defective endogenous gene present in a chromosome of a target cell.

Any of the vectors described herein can further include a control sequence, e.g., a control sequence selected from the group of a transcription initiation sequence, a transcription termination sequence, a promoter sequence, an enhancer sequence, an RNA splicing sequence, a polyadenylation (polyA) sequence, and a Kozak consensus sequence. Non-limiting examples of these control sequences are described herein. In some embodiments, a promoter can be a native promoter, a constitutive promoter, an inducible promoter, and/or a tissue-specific promoter.

Promoters

Non-limiting examples of promoters are described herein. Additional examples of promoters are known in the art.

In some embodiments, a vector encoding an N-terminal portion of an otoferlin protein (e.g., a human otoferlin protein) can include a promoter and/or an enhancer. The vector encoding the N-terminal portion of the otoferlin protein can include any of the promoters and/or enhancers described herein or known in the art.

In some embodiments, the promoter is an inducible promoter, a constitutive promoter, a mammalian cell promoter, a viral promoter, a chimeric promoter, an engineered promoter, a tissue-specific promoter, or any other type of promoter known in the art. In some embodiments, the promoter is a RNA polymerase II promoter, such as a mammalian RNA polymerase II promoter. In some embodiments, the promoter is a RNA polymerase III promoter, including, but not limited to, a H1 promoter, a human U6 promoter, a mouse U6 promoter, or a swine U6 promoter. The promoter will generally be one that is able to promote transcription in cochlear cells such as hair cells. In some examples, the promoter is a cochlea-specific promoter or a cochlea-oriented promoter.

A variety of promoters are known in the art that can be used herein. Non-limiting examples of promoters that can be used herein include: human elongation factor 1α-subunit (EF1a) (Liu et al. (2007) Exp. Mol. Med. 39(2): 170-175; Accession No. J04617.1; Gill et al., Gene Ther. 8(20):1539-1546, 2001; Xu et al., Human Gene Ther. 12(5):563-573, 2001; Xu et al., Gene Ther. 8:1323-1332; Ikeda et al., Gene Ther. 9:932-938, 2002; Gilham et al., J. Gene Med. 12(2): 129-136, 2010), cytomegalovirus (Xu et al., Human Gene Ther. 12(5):563-573, 2001; Xu et al., Gene Ther. 8:1323-1332; Gray et al., Human Gene Ther. 22:1143-1153, 2011), human immediate-early cytomegalovirus (CMV) (U.S. Pat. No. 5,168,062, Liu et al. (2007) Exp. Mol. Med. 39(2): 170-175; Accession No. X17403.1 or KY490085.1), human ubiquitin C (UBC) (Gill et al., Gene Ther. 8(20):1539-1546, 2001; Qin et al., PLoS One 5(5):e10611, 2010), mouse phosphoglycerate kinase 1, polyoma adenovirus, simian virus 40 (SV40), β-globin, p-actin, α-fetoprotein, γ-globin, β-interferon, γ-glutamyl transferase, mouse mammary tumor virus (MMTV), Rous sarcoma virus, rat insulin, glyceraldehyde-3-phosphate dehydrogenase, metallothionein II (MT II), amylase, cathepsin, MI muscarinic receptor, retroviral LTR (e.g. human T-cell leukemia virus HTLV), AAV ITR, interleukin-2, collagenase, platelet-derived growth factor, adenovirus 5 E2, stromelysin, murine MX gene, glucose regulated proteins (GRP78 and GRP94), α-2-macroglobulin, vimentin, MHC class I gene H-2κ b, HSP70, proliferin, tumor necrosis factor, thyroid stimulating hormone α gene, immunoglobulin light chain, T-cell receptor, HLA DQa and DQP, interleukin-2 receptor, MHC class II, MHC class II HLA-DRa, muscle creatine kinase, prealbumin (transthyretin), elastase I, albumin gene, c-fos, c-HA-ras, neural cell adhesion molecule (NCAM), H2B (TH2B) histone, rat growth hormone, human serum amyloid (SAA), troponin I (TN I), duchenne muscular dystrophy, human immunodeficiency virus, Gibbon Ape Leukemia Virus (GALV) promoters, promoter of HNRPA2B1-CBX1 (UCOE) (Powell and Gray (2015) Discov. Med. 19(102): 49-57; Antoniou et al., Human Gene Ther. 24(4):363-374, 2013), β-glucuronidase (GUSB) (Husain et al., Gene Ther. 16:927-932, 2009), chicken β-actin (CBA) (Liu et al. (2007) Exp. Mol. Med. 39(2): 170-175; Stone et al. (2005) Mol. Ther. 11(6): 843-848; Klein et al., Exp. Neurol. 176(1):66-74, 2002; Ohlfest et al., Blood 105:2691-2698, 2005; Gray et al., Human Gene Ther. 22:1143-1153, 2011), a human β-actin promoter (HBA) (Accession No. Y00474.1), murine myosin VIIA (musMyo7) (Boeda et al. (2001) Hum. Mol. Genet. 10(15): 1581-1589; Accession No. AF384559.1), human myosin VIIA (hsMyo7) (Boeda et al. (2001) Hum. Mol. Genet. 10(15): 1581-1589; Accession No. NG_009086.1), murine poly(ADP-ribose) polymerase 2 (musPARP2) (Ame et al. (2001) J. Biol. Chem. 276(14): 11092-11099; Accession No. AF191547.1), human poly(ADP-ribose) polymerase 2 (hsPARP2) (Ame et al. (2001) J. Biol. Chem. 276(14): 11092-11099; Accession No. X16612.1 or AF479321.1), acetylcholine receptor epsilon-subunit (AChε) (Duclert et al. (1993) PNAS 90(7): 3043-3047; Accession No. S58221.1 or CR933736.12), Rous sarcoma virus (RSV) (Liu et al. (2007) Exp. Mol. Med. 39(2): 170-175; Accession No. M77786.1), (GFAP) (Liu et al. (2007) Exp. Mol. Med. 39(2): 170-175; Stone et al. (2005) Mol. Ther. 11(6): 843-848; Accession No. NG_008401.1 or M67446.1), hAAT (Van Linthout et al., Human Gene Ther. 13(7):829-840, 2002; Cunningham et al., Mol. Ther. 16(6):1081-1088, 2008), and a CBA hybrid (CBh) (Gray et al. (2011) Hum. Gen. Therapy 22: 1143-1153; Accession No. KF926476.1 or KC152483.1). Additional examples of promoters are known in the art. See, e.g., Lodish, Molecular Cell Biology, Freeman and Company, New York 2007. In some embodiments, the promoter is the CMV immediate early promoter.

In some embodiments, the promoter is a CAG promoter or a CAG/CBA promoter. In some embodiments, a vector or construct of the present disclosure comprises a CAG promoter. In some embodiments, a CAG promoter comprises, in order from 5' to 3', the nucleotide sequences of SEQ ID NOs: 98, 99, and 100. In some such embodiments, a CAG promoter comprises a CMV early enhancer element (e.g., SEQ ID NO: 98), a chicken beta actin (CBA) gene sequence (e.g., SEQ ID NO: 99), and a chimeric intron/3' splice sequence from the rabbit beta globin gene (e.g., SEQ ID NO: 100).

The term "operably linked" or "transcriptional control" refers to functional linkage between a regulatory sequence and a heterologous nucleic acid sequence resulting in expression of the latter. For example, a first nucleic acid sequence is operably linked with a second nucleic acid sequence when the first nucleic acid sequence is placed in a functional relationship with the second nucleic acid sequence. For instance, a promoter is operably linked to a coding sequence if the promoter affects the transcription or expression of the coding sequence. Operably linked DNA sequences can be contiguous with each other and, e.g., where necessary to join two protein coding regions, are in the same reading frame.

The term "constitutive" promoter refers to a nucleotide sequence that, when operably linked with a nucleic acid encoding a protein (e.g., an otoferlin protein), causes RNA to be transcribed from the nucleic acid in a mammalian cell under most or all physiological conditions.

The term "constitutive" promoter refers to a nucleotide sequence which, when operably linked with a polynucleotide which encodes or specifies a gene product, causes the gene product to be produced in a cell under most or all physiological conditions of the cell.

Examples of constitutive promoters include, without limitation, the retroviral Rous sarcoma virus (RSV) LTR promoter, the cytomegalovirus (CMV) promoter (see, e.g., Boshart et al. Cell 41:521-530, 1985), the SV40 promoter, the dihydrofolate reductase promoter, the beta-actin promoter, the phosphoglycerol kinase (PGK) promoter, and the EF1-alpha promoter (Invitrogen).

The term "inducible" promoter refers to a nucleotide sequence which, when operably linked with a polynucleotide which encodes or specifies a gene product, causes the gene product to be produced in a cell substantially only when an inducer which corresponds to the promoter is present in the cell.

Inducible promoters allow regulation of gene expression and can be regulated by exogenously supplied compounds, environmental factors such as temperature, or the presence of a specific physiological state, e.g., acute phase, a particular differentiation state of the cell, or in replicating cells only. Inducible promoters and inducible systems are available from a variety of commercial sources, including, without limitation, Invitrogen, Clontech, and Ariad. Additional examples of inducible promoters are known in the art.

Examples of inducible promoters regulated by exogenously supplied compounds include the zinc-inducible sheep metallothionine (MT) promoter, the dexamethasone (Dex)-inducible mouse mammary tumor virus (MMTV) promoter, the T7 polymerase promoter system (WO 98/10088); the ecdysone insect promoter (No et al. *Proc. Natl. Acad. Sci. U.S.A.* 93:3346-3351, 1996), the tetracycline-repressible system (Gossen et al. *Proc. Natl. Acad. Sci. U.S.A.* 89:5547-5551, 1992), the tetracycline-inducible system (Gossen et al. *Science* 268:1766-1769, 1995, see also Harvey et al. *Curr. Opin. Chem. Biol.* 2:512-518, 1998), the RU486-inducible system (Wang et al. *Nat. Biotech.* 15:239-243, 1997) and Wang et al. *Gene Ther.* 4:432-441, 1997), and the rapamycin-inducible system (Magari et al. *J. Clin. Invest.* 100:2865-2872, 1997).

The term "tissue-specific" promoter refers to a promoter that is active only in certain specific cell types and/or tissues (e.g., transcription of a specific gene occurs only within cells expressing transcription regulatory proteins that bind to the tissue-specific promoter).

The term "tissue-specific" promoter refers to a nucleotide sequence which, when operably linked with a polynucleotide encodes or specified by a gene, causes the gene product to be produced in a cell substantially only if the cell is a cell of the tissue type corresponding to the promoter.

The term "regulatory sequence" refers to a nucleic acid sequence which is regulates expression of a gene product operably linked to the regulatory sequence. In some instances, this sequence may be an enhancer sequence and other regulatory elements which regulate expression of the gene product.

In some embodiments, the regulatory sequences impart tissue-specific gene expression capabilities. In some cases, the tissue-specific regulatory sequences bind tissue-specific transcription factors that induce transcription in a tissue-specific manner.

In some embodiments, the tissue-specific promoter is a cochlea-specific promoter. In some embodiments, the tissue-specific promoter is a cochlear hair cell-specific promoter. Non-limiting examples of cochlear hair cell-specific promoters include but are not limited to: a ATOH1 promoter, a POU4F3 promoter, a LHX3 promoter, a MYO7A promoter, a MYO6 promoter, a α9ACHR promoter, and a α10ACHR promoter.

Enhancers and 5' Cap

In some instances, a vector can include a promoter sequence and/or an enhancer sequence. The term "enhancer" refers to a nucleotide sequence that can increase the level of transcription of a nucleic acid encoding a protein of interest (e.g., an otoferlin protein), Enhancer sequences (50-1500 base pairs in length) generally increase the level of transcription by providing additional binding sites for transcription-associated proteins (e.g., transcription factors). In some embodiments, an enhancer sequence is found within an intronic sequence. Unlike promoter sequences, enhancer sequences can act at much larger distance away from the transcription start site (e.g., as compared to a promoter). Non-limiting examples of enhancers include a RSV enhancer, a CMV enhancer, and a SV40 enhancer. An example of a CMV enhancer is described in, e.g., Boshart et al., Cell 41(2):521-530, 1985.

As used herein, a 5' cap (also termed an RNA cap, an RNA 7-methylguanosine cap or an RNA m.sup.7G cap) is a modified guanine nucleotide that has been added to the "front" or 5' end of a eukaryotic messenger RNA shortly after the start of transcription. The 5' cap consists of a terminal group which is linked to the first transcribed nucleotide. Its presence is critical for recognition by the ribosome and protection from RNases. Cap addition is coupled to transcription, and occurs co-transcriptionally, such that each influences the other. Shortly after the start of transcription, the 5' end of the mRNA being synthesized is bound by a cap-synthesizing complex associated with RNA polymerase. This enzymatic complex catalyzes the chemical reactions that are required for mRNA capping. Synthesis proceeds as a multi-step biochemical reaction. The capping moiety can be modified to modulate functionality of mRNA such as its stability or efficiency of translation.

Poly(A) Sequences

In some embodiments, any of the vectors provided herein can include a poly(A) sequence. Most nascent eukaryotic mRNAs possess a poly(A) tail at their 3' end which is added during a complex process that includes cleavage of the primary transcript and a coupled polyadenylation reaction (see, e.g., Proudfoot et al., *Cell* 108:501-512, 2002). The poly(A) tail confers mRNA stability and transferability (Molecular Biology of the Cell, Third Edition by B. Alberts et al., Garland Publishing, 1994). In some embodiments, the poly(A) sequence is positioned 3' to the nucleic acid sequence encoding the C-terminus of the otoferlin protein.

As used herein, "polyadenylation" refers to the covalent linkage of a polyadenylyl moiety, or its modified variant, to a messenger RNA molecule. In eukaryotic organisms, most messenger RNA (mRNA) molecules are polyadenylated at the 3' end. The 3' poly(A) tail is a long sequence of adenine nucleotides (often several hundred) added to the pre-mRNA through the action of an enzyme, polyadenylate polymerase. In higher eukaryotes, the poly(A) tail is added onto transcripts that contain a specific sequence, the polyadenylation signal. The poly(A) tail and the protein bound to it aid in protecting mRNA from degradation by exonucleases. Polyadenylation is also important for transcription termination, export of the mRNA from the nucleus, and translation. Polyadenylation occurs in the nucleus immediately after transcription of DNA into RNA, but additionally can also occur later in the cytoplasm. After transcription has been terminated, the mRNA chain is cleaved through the action of an endonuclease complex associated with RNA polymerase. The cleavage site is usually characterized by the presence of the base sequence AAUAAA near the cleavage site. After the mRNA has been cleaved, adenosine residues are added to the free 3' end at the cleavage site.

As used herein, a "poly(A) signal sequence" is a sequence that triggers the endonuclease cleavage of an mRNA and the additional of a series of adenosines to the 3' end of the cleaved mRNA.

As used herein, a "poly(A)" is a series of adenosines attached by polyadenylation to the mRNA. In the preferred embodiment of a construct for transient expression, the polyA is between 50 and 5000, preferably greater than 64, more preferably greater than 100, most preferably greater than 300 or 400. Poly(A) sequences can be modified chemically or enzymatically to modulate mRNA functionality such as localization, stability or efficiency of translation.

There are several poly(A) signal sequences that can be used, including those derived from bovine growth hormone (bgh) (Woychik et al., *Proc. Natl. Acad. Sci. U.S.A.* 81(13): 3944-3948, 1984; U.S. Pat. No. 5,122,458; Yew et al., Human Gene Ther. 8(5):575-584, 1997; Xu et al., *Human Gene Ther.* 12(5):563-573, 2001; Xu et al., *Gene Ther.* 8:1323-1332, 2001; Wu et al., *Mol. Ther.* 16(2):280-289, 2008; Gray et al., *Human Gene Ther.* 22:1143-1153, 2011; Choi et al., *Mol. Brain* 7:17, 2014), mouse-p-globin, mouse-α-globin (Orkin et al., *EMBO J.* 4(2):453-456, 1985; Thein et al., *Blood* 71(2):313-319, 1988), human collagen, polyoma virus (Batt et al., *Mol. Cell Biol.* 15(9):4783-4790, 1995), the Herpes simplex virus thymidine kinase gene (HSV TK), IgG heavy-chain gene polyadenylation signal (US 2006/0040354), human growth hormone (hGH) (Szymanski et al., *Mol. Therapy* 15(7):1340-1347, 2007; Ostegaard et al., *Proc. Natl. Acad. Sci. U.S.A.* 102(8):2952-2957, 2005), synthetic polyA (Levitt et al., *Genes Dev.* 3(7):1019-1025, 1989; Yew et al., *Human Gene Ther.* 8(5): 575-584, 1997; Ostegaard et al., *Proc. Natl. Acad. Sci. U.S.A.* 102(8):2952-2957, 2005; Choi et al., *Mol. Brain* 7:17, 2014), HIV-1 upstream poly(A) enhancer (Schambach et al., *Mol. Ther.* 15(6):1167-1173, 2007), adenovirus (L3) upstream poly(A) enhancer (Schambach et al., *Mol. Ther.* 15(6):1167-1173, 2007), hTHGB upstream poly(A) enhancer (Schambach et al., *Mol. Ther.* 15(6):1167-1173, 2007), hC2 upstream poly(A) enhancer (Schambach et al., *Mol. Ther.* 15(6):1167-1173, 2007), the group consisting of SV40 poly(A) signal sequence, such as the SV40 late and early poly(A) signal sequence (Schek et al., *Mol. Cell Biol.* 12(12):5386-5393, 1992; Choi et al., *Mol. Brain* 7:17, 2014; Schambach et al., *Mol. Ther.* 15(6):1167-1173, 2007). A non-limiting example of a poly(A) signal sequence is SEQ ID NO: 68, 76, or 77.

The poly(A) signal sequence can be the sequence AATAAA. The AATAAA sequence may be substituted with other hexanucleotide sequences with homology to AATAAA which are capable of signaling polyadenylation, including ATTAAA, AGTAAA, CATAAA, TATAAA, GATAAA, ACTAAA, AATATA, AAGAAA, AATAAT, AAAAAA, AATGAA, AATCAA, AACAAA, AATCAA, AATAAC, AATAGA, AATTAA, or AATAAG (see, e.g., WO 06/12414).

In some embodiments, the poly(A) signal sequence can be a synthetic polyadenylation site (see, e.g., the pCl-neo expression vector of Promega which is based on Levitt el al, *Genes Dev.* 3(7):1019-1025, 1989). In some embodiments, the poly(A) signal sequence is the polyadenylation signal of soluble neuropilin-1 (sNRP) (AAATAAAATACGAAATG) (see, e.g., WO 05/073384). In some embodiments, a poly(A) sequence is a bovine growth hormone poly(A) sequence. In some such embodiments, a bGH poly(A) sequence comprises or is the sequence of SEQ ID NO: 108. In some embodiments, a vector or construct of the present disclosure comprises a boving growth hormone polyA sequence represented by SEQ ID NO: 108. Additional examples of poly(A) signal sequences are known in the art.

In some embodiments, any of the vectors provided herein can include a woodchuck hepatitis virus posttranscriptional regulatory element (WPRE), e.g., SEQ ID NO: 69.

Internal Ribosome Entry Site (IRES)

In some embodiments, a vector encoding the C-terminus of the otoferlin protein can include a polynucleotide internal ribosome entry site (IRES). An IRES sequence is used to produce more than one polypeptide from a single gene transcript. An IRES forms a complex secondary structure that allows translation initiation to occur from any position with an mRNA immediately downstream from where the IRES is located (see, e.g., Pelletier and Sonenberg, *Mol. Cell. Biol.* 8(3):1103-1112, 1988).

There are several IRES sequences known to those skilled in the art, including those from, e.g., foot and mouth disease virus (FMDV), encephalomyocarditis virus (EMCV), human rhinovirus (HRV), cricket paralysis virus, human immunodeficiency virus (HIV), hepatitis A virus (HAV), hepatitis C virus (HCV), and poliovirus (PV). See e.g., Alberts, Molecular Biology of the Cell, Garland Science, 2002; and Hellen et al., *Genes Dev.* 15(13):1593-612, 2001.

In some embodiments, the IRES sequence that is incorporated into the vector that encodes the C-terminus of an otoferlin protein is the foot and mouth disease virus (FMDV). The Foot and Mouth Disease Virus 2A sequence is a small peptide (approximately 18 amino acids in length) that has been shown to mediate the cleavage of polyproteins (Ryan, M D et al., *EMBO* 4:928-933, 1994; Mattion et al., *J. Virology* 70:8124-8127, 1996; Furler et al., *Gene Therapy* 8:864-873, 2001; and Halpin et al, *Plant Journal* 4:453-459, 1999). The cleavage activity of the 2A sequence has previously been demonstrated in artificial systems including plasmids and gene therapy vectors (AAV and retroviruses) (Ryan et al., *EMBO* 4:928-933, 1994; Mattion et al., *J. Virology* 70:8124-8127, 1996; Furler et al., *Gene Therapy* 8:864-873, 2001; and Halpin et al., *Plant Journal* 4:453-459, 1999; de Felipe et al., *Gene Therapy* 6:198-208, 1999; de Felipe et al., *Human Gene Therapy* 11:1921-1931, 2000; and Klump et al., *Gene Therapy* 8:811-817, 2001).

Reporter Sequences

Any of the vectors provided herein can optionally include a sequence encoding a reporter protein ("a reporter sequence"). Non-limiting examples of reporter sequences are described herein. Additional examples of reporter sequences are known in the art. In some embodiments, the reporter sequence can be used to verify the tissue-specific targeting capabilities and tissue-specific promoter regulatory activity of any of the vectors described herein.

NTF3

Any of the vectors provided herein can optionally include a sequence encoding a neurotrophin-3 (NTF3) protein. In some embodiments, a NTF3 protein can have a sequence that is at least 70% identical, at least 72% identical, at least 74% identical, at least 76% identical, at least 78% identical, at least 80% identical, at least 82% identical, at least 84% identical, at least 86% identical, at least 88% identical, at least 90% identical, at least 92% identical, at least 94% identical, at least 96% identical, at least 98% identical, at least 99% identical, or 100% identical to SEQ ID NO: 78. In some embodiments, a NTF3 protein can include a sequence that is identical to SEQ ID NO: 78, except that it includes 1, 2, 3, 4, 5, 6, 7, 8, 9, 10, 11, 12, 13, 14, 15, 16, 17, 18, 19, or 20 amino acid substitutions and/or deletions.

In some embodiments, a NTF3 protein can be encoded by a sequence that is at least 70% identical, at least 72% identical, at least 74% identical, at least 76% identical, at least 78% identical, at least 80% identical, at least 82% identical, at least 84% identical, at least 86% identical, at least 88% identical, at least 90% identical, at least 92% identical, at least 94% identical, at least 96% identical, at least 98% identical, at least 99% identical, or 100% identical to SEQ ID NO: 79 or 80.

One skilled in the art would appreciate that mutation of amino acids that are not conserved between the same protein from different species is less likely to have an effect on the function of a protein and therefore, these amino acids should be selected for mutation. Amino acids that are conserved between the same protein from different species should not be mutated, as these mutations are more likely to result in a change in the function of the protein. Non-limiting examples of neutrophin-3 from other mammalian species are shown below.
Cow Neurotrophin-3 (SEQ ID NO: 81)
Rat Neurotrophin-3 (SEQ ID NO: 82)
Pig Neurotrophin-3 (SEQ ID NO: 83)
Flanking Regions Untranslated Regions (UTRs)

In some embodiments, any of the vectors described herein (e.g., any of the at least two different vectors) can include an untranslated region. In some embodiments, a vector can includes a 5' UTR or a 3' UTR.

Untranslated regions (UTRs) of a gene are transcribed but not translated. The 5' UTR starts at the transcription start site and continues to the start codon but does not include the start codon. The 3' UTR starts immediately following the stop codon and continues until the transcriptional termination signal. There is growing body of evidence about the regulatory roles played by the UTRs in terms of stability of the nucleic acid molecule and translation. The regulatory features of a UTR can be incorporated into any of the vectors, compositions, kits, or methods as described herein to enhance the stability of an otoferlin protein.

Kozak Sequences

Natural 5' UTRs include a sequence that plays a role in translation initiation. They harbor signatures like Kozak sequences, which are commonly known to be involved in the process by which the ribosome initiates translation of many genes. Kozak sequences have the consensus sequence CCR(A/G)CCAUGG, where R is a purine (A or G) three bases upstream of the start codon (AUG), which is followed by another "G". The 5' UTRs have also been known, e.g., to form secondary structures that are involved in elongation factor binding.

For example, in some embodiments, a 5' UTR is included in any of the vectors described herein. Non-limiting examples of 5' UTRs including those from the following genes: albumin, serum amyloid A, Apolipoprotein A/B/E, transferrin, alpha fetoprotein, erythropoietin, and Factor VIII, can be used to enhance expression of a nucleic acid molecule, such as a mRNA.

In some embodiments, a 5' UTR from a mRNA that is transcribed by a cell in the cochlea can be included in any of the vectors, compositions, kits, and methods described herein.

3' UTRs are known to have stretches of adenosines and uridines embedded in them. These AU-rich signatures are particularly prevalent in genes with high rates of turnover. Based on their sequence features and functional properties, the AU-rich elements (AREs) can be separated into three classes (Chen et al., *Mol. Cell. Biol.* 15:5777-5788, 1995; Chen et al., *Mol. Cell Biol.* 15:2010-2018, 1995): Class I AREs contain several dispersed copies of an AUUUA motif within U-rich regions. For example, c-Myc and MyoD mRNAs contain class I AREs. Class II AREs possess two or more overlapping UUAUUUA(U/A) (U/A) nonamers. GM-CSF and TNF-alpha mRNAs are examples that contain class II AREs. Class III AREs are less well defined. These U-rich regions do not contain an AUUUA motif. Two well-studied examples of this class are c-Jun and myogenin mRNAs.

Most proteins binding to the AREs are known to destabilize the messenger, whereas members of the ELAV family, most notably HuR, have been documented to increase the stability of mRNA. HuR binds to AREs of all the three classes. Engineering the HuR specific binding sites into the 3' UTR of nucleic acid molecules will lead to HuR binding and thus, stabilization of the message in vivo.

In some embodiments, the introduction, removal, or modification of 3' UTR AREs can be used to modulate the stability of an mRNA encoding an otoferlin protein. In other embodiments, AREs can be removed or mutated to increase the intracellular stability and thus increase translation and production of an otoferlin protein.

Splice Donor and Splice Acceptor Sequences

In other embodiments, non-UTR sequences may be incorporated into the 5' or 3' UTRs. In some embodiments, introns or portions of intron sequences may be incorporated into the flanking regions of the polynucleotides in any of the vectors, compositions, kits, and methods provided herein. Incorporation of intronic sequences may increase protein production as well as mRNA levels. An intron can be an intron from an otoferlin gene or can be an intron from a heterologous gene, e.g., a hybrid adenovirus/mouse immunoglobulin intron (Yew et al., *Human Gene Ter.* 8(5):575-584, 1997), an SV40 intron (Ostedgaard et al., *Proc. Natl. Acad. Sci. U.S.A.* 102(8):2952-2957, 2005), an MVM intron (Wu et al., *Mol. Ther.* 16(2):280-289, 2008), a factor IX truncated intron 1 (Wu et al., *Mol. Ther.* 16(2):280-289, 2008; Kurachi et al., *J. Biol. Chem.* 270(10):5276-5281, 1995), a chimeric J-globulin splice donor/immunoglobulin heavy chain splice acceptor intron (Wu et al., *Mol. Ther.* 16(2):280-289, 2008; Choi et al., *Mol. Brain* 7:17, 2014), SV40 late splice donor/splice acceptor intron (19S/16S) (Yew et al., *Human Gene Ther.* 8(5):575-584, 1997), hybrid adenovirus spice donor/IgG splice acceptor (Choi et al., *Mol. Brain* 7:17, 1991; Huang and Gorman, *Mol. Cell Biol.* 10(4):1805-1810, 1990).

Non-limiting examples of a splice donor and splice acceptor sequences are SEQ ID NOs: 64 and 65, respectively; SEQ ID NOs: 72 and 73, respectively; and SEQ ID NOs: 74 and 75, respectively. In some embodiments, the splice donor sequence has the sequence of SEQ ID NO: 102. In some embodiments, a vector of construct of the present disclosure comprises a splice donor sequence of SEQ ID NO: 102. In some such embodiments, the vector or construct comprising a splice donor sequence (e.g., SEQ ID NO: 102) also comprises a 5' portion of the OTOF gene or OTOF cDNA (e.g., SEQ ID NO: 101) upstream of the splice donor sequence. In some embodiments, the splice acceptor sequence has the sequence of SEQ ID NO: 106. In some embodiments, a vector or construct of the present disclosure comprises a splice acceptor sequence of SEQ ID NO: 106. In some such embodiments, the vector or construct comprising a splice acceptor sequence (e.g., SEQ ID NO: 106) also comprises a 3' portion of the OTOF gene or OTOF cDNA (e.g., SEQ ID NO: 107) downstream of the splice acceptor sequence.

Destabilization Domains Any of the vectors provided herein can optionally include a sequence encoding a destabilization domain ("a destabilization domain sequence"). A destabilization domain is an amino acid sequence that decreases the in vivo or in vitro half-life of a protein that includes the destabilization domain, e.g., as compared to the same protein lacking the stabilization domain. For example, a destabilization domain may result in the targeting of a protein that includes the destabilization domain for proteosomal degradation. Non-limiting examples of destabilization domains include the destabilizing domain of the *E. coli* dihydrofolate reductase (DHFR) (Iwamoto et al. (2010) *Chem. Biol.* 17(9): 981-998) and FK-506 binding protein (FKBP) (Wenlin et al. (2015) PLoS One 10(12): e0145783). SEQ ID NO: 53 is an exemplary amino acid sequence of a DHFR destabilization domain. Additional examples of destabilization domains are known in the art.

In some embodiments, any of the vectors provided herein can optionally include a degradation sequence, e.g., a CL1 degradation sequence of SEQ ID NO: 71.

Recombinogenic Sequences

In some embodiments, one or more vectors or constructs of the present disclosure comprise(s) one or more recombinogenic sequences. In some embodiments, a recombinogenic sequence is or comprises a portion of a gene sequence. In some embodiments, a recombinogenic sequence is derived from an alkaline phosphatase gene. In some embodiments, a recombinogenic sequence is derived from an F1 phage. In some such embodiments, a recombinogenic sequence is an AK sequence derived from an F1 phage. In some embodiments, such an AK recombinogenic sequence is SEQ ID NO: 103. In some embodiments of a dual vector system of the present disclosure, each of two vectors comprises a recombinogenic sequence.

In some embodiments, a composition of the present disclosure comprises a first vector with a splice donor sequence (e.g., SEQ ID NO: 102) located downstream of a 5' portion of the OTOF gene or OTOF cDNA (e.g., SEQ ID NO: 101) and upstream of an AK recombinogenic sequence (e.g., SEQ ID NO: 103) and a second vector with a splice acceptor sequence (e.g., SEQ ID NO: 106) located upstream of a 3' portion of the OTOF gene or OTOF cDNA (e.g., SEQ ID NO: 107) and downstream of an AK recombinogenic sequence (e.g., SEQ ID NO: 103).

Additional Sequences

Any of the vectors provided herein can optionally include additional nucleotide sequences ("a stuffer sequence") in order to optimize the total number of base pairs in the vector. For example, in order to optimize packaging, each vector can be designed to contain a total of about 4,000 base pairs to about 4,700 base pairs, e.g., about 4,000 base pairs to about 4,650 base pairs, about 4,000 base pairs to about 4,600 base pairs, about 4,000 base pairs to about 4,550 base pairs, about 4,000 base pairs to about 4,500 base pairs, about 4,000 base pairs to about 4,450 base pairs, about 4,000 base pairs to about 4,400 base pairs, about 4,000 base pairs to about 4,350 base pairs, about 4,000 base pairs to about 4,300 base pairs, about 4,000 base pairs to about 4,250 base pairs, about 4,000 base pairs to about 4,200 base pairs, about 4,000 base pairs to about 4,150 base pairs, about 4,000 base pairs to about 4,100 base pairs, about 4,000 base pairs to about 4,050 base pairs, about 4,050 base pairs to about 4,700 base pairs, about 4,050 base pairs to about 4,650 base pairs, about 4,050 base pairs to about 4,600 base pairs, about 4,050 base pairs to about 4,550 base pairs, about 4,050 base pairs to about 4,500 base pairs, about 4,050 base pairs to about 4,450 base pairs, about 4,050 base pairs to about 4,400 base pairs, about 4,050 base pairs to about 4,350 base pairs, about 4,050 base pairs to about 4,300 base pairs, about 4,050 base pairs to about 4,250 base pairs, about 4,050 base pairs to about 4,200 base pairs, about 4,050 base pairs to about 4,150 base pairs, about 4,050 base pairs to about 4,100 base pairs, about 4,100 base pairs to about 4,700 base pairs, about 4,100 base pairs to about 4,650 base pairs, about 4,100 base pairs to about 4,600 base pairs, about 4,100 base pairs to about 4,550 base pairs, about 4,100 base pairs to about 4,500 base pairs, about 4,100 base pairs to about 4,450 base pairs, about 4,100 base pairs to about 4,400 base pairs, about 4,100 base pairs to about 4,350 base pairs, about 4,100 base pairs to about 4,300 base pairs, about 4,100 base pairs to about 4,250 base pairs, about 4,100 base pairs to about 4,200 base pairs, about 4,100 base pairs to about 4,150 base pairs, about 4,150 base pairs to about 4,700 base pairs, about 4,150 base pairs to about 4,650 base pairs, about 4,150 base pairs to about 4,600 base pairs, about 4,150 base pairs to about 4,550 base pairs, about 4,150 base pairs to about 4,500 base pairs, about 4,150 base pairs to about 4,450 base pairs, about 4,150 base pairs to about 4,400 base pairs, about 4,150 base pairs to about 4,350 base pairs, about 4,150 base pairs to about 4,300 base pairs, about 4,150 base pairs to about 4,250 base pairs, about 4,150 base pairs to about 4,200 base pairs, about 4,200 base pairs to about 4,700 base pairs, about 4,200 base pairs to about 4,650 base pairs, about 4,200 base pairs to about 4,600 base pairs, about 4,200 base pairs to about 4,550 base pairs, about 4,200 base pairs to about 4,500 base pairs, about 4,200 base pairs to about 4,450 base pairs, about 4,200 base pairs to about 4,400 base pairs, about 4,200 base pairs to about 4,350 base pairs, about 4,200 base pairs to about 4,300 base pairs, about 4,200 base pairs to about 4,250 base pairs, about 4,250 base pairs to about 4,700 base pairs, about 4,250 base pairs to about 4,650 base pairs, about 4,250 base pairs to about 4,600 base pairs, about 4,250 base pairs to about 4,550 base pairs, about 4,250 base pairs to about 4,500 base pairs, about 4,250 base pairs to about 4,450 base pairs, about 4,250 base pairs to about 4,400 base pairs, about 4,250 base pairs to about 4,350 base pairs, about 4,250 base pairs to about 4,300 base pairs, about 4,300 base pairs to about 4,700 base pairs, about 4,300 base pairs to about 4,650 base pairs, about 4,300 base pairs to about 4,600 base pairs, about 4,300 base pairs to about 4,550 base pairs, about 4,300 base pairs to about 4,500 base pairs, about 4,300 base pairs to about 4,450 base pairs, about 4,300 base pairs to about 4,400 base pairs, about 4,300 base pairs to about 4,350 base pairs, about 4,350 base pairs to about 4,700 base pairs, about 4,350 base pairs to about 4,650 base pairs, about 4,350 base pairs to about 4,600 base pairs, about 4,350 base pairs to about 4,550 base pairs, about 4,350 base pairs to about 4,500 base pairs, about 4,350 base pairs to about 4,450 base pairs, about 4,350 base pairs to about 4,400 base pairs, about 4,400 base pairs to about 4,700 base pairs, about 4,400 base pairs to about 4,650 base pairs, about 4,400 base pairs to about 4,600 base pairs, about 4,400 base pairs to about 4,550 base pairs, about 4,400 base pairs to about 4,500 base pairs, about 4,400 base pairs to about 4,450 base pairs, about 4,450 base pairs to about 4,700 base pairs, about 4,450 base pairs to about 4,650 base pairs, about 4,450 base pairs to about 4,600 base pairs, about 4,450 base pairs to about 4,550 base pairs, about 4,450 base pairs to about 4,500 base pairs, about 4,500 base pairs to about 4,700 base pairs, about 4,500 base pairs to about 4,650 base pairs, about 4,500 base pairs to about 4,600 base pairs, about 4,500 base pairs to about 4,550 base pairs, about 4,550 base pairs to about 4,700 base pairs, about 4,550 base pairs to about 4,650 base pairs, about 4,550 base pairs to about 4,600 base pairs, about 4,600 base pairs to about 4,700 base pairs, about 4,600 base pairs to about 4,650 base pairs, or about 4,650 base pairs to about 4,700 base pairs (inclusive).

A stuffer sequence can be any nucleotide sequence, e.g., up to 1000 bp, that can be included in any of the vectors described herein that is not transcribed and that does not serve a regulatory function in order to achieve a desirable vector size (e.g., a vector size of about 4 kb to about 5 kb, or any of the vector sizes provided herein). For example, a stuffer sequence can be any nucleotide sequence of about 100 bp to about 1000 bp (e.g., about 100 bp to about 900 bp, about 100 bp to about 800 bp, about 100 bp to about 700 bp, about 100 bp to about 600 bp, about 100 bp to about 500 bp, about 100 bp to about 400 bp, about 100 bp to about 300 bp, about 100 bp to about 100 bp, about 200 bp to about 1000 bp, about 200 bp to about 900 bp, about 200 bp to about 800 bp, about 200 bp to about 700 bp, about 200 bp to about 600 bp, about 200 bp to about 500 bp, about 200 bp to about 400 bp, about 200 bp to about 300 bp, about 300 bp to about 1000 bp, about 300 bp to about 900 bp, about 300 bp to about 800 bp, about 300 bp to about 700 bp, about 300 bp to about 600 bp, about 300 bp to about 500 bp, about 300 bp to about 400 bp, about 400 bp to about 1000 bp, about 400 bp to about 900 bp, about 400 bp to about 800 bp, about 400 bp to about 700 bp, about 400 bp to about 600 bp, about 400 bp to about 500 bp, about 500 bp to about 1000 bp, about 500 bp to about 900 bp, about 500 bp to about 800 bp, about 500 bp to about 700 bp, about 500 bp to about 600 bp, about 600 bp to about 1000 bp, about 600 bp to about 900 bp, about 600 bp to about 800 bp, about 600 bp to about 700 bp, about 700 bp to about 1000 bp, about 700 bp to about 900 bp, about 700 bp to about 800 bp, about 800 bp to about 1000 bp, about 800 bp to about 900 bp, about 900 bp to about 1000 bp, about 100 bp, about 150 bp, about 200 bp, about 250 bp, about 300 bp, about 350 bp, about 400 bp, about 450 bp, about 500 bp, about 550 bp, about 600 bp, about 650 bp, about 700 bp, about 750 bp, about 800 bp, about 850 bp, about 900 bp, about 950 bp, or about 1000 bp. SEQ ID NOs. 54-58, 90 and 91 are exemplary human factor VIII stuffer sequences that can be used in any of the vectors described herein. Additional stuffer sequences are known in the art. Exemplary vectors that include stuffer sequences are shown in FIGS. 21-31, 36, 37, 59-63 and 66.

Dual AAV Vector Compositions

In some embodiments, the present disclosure provides compositions comprising one or more vectors to deliver a therapeutic gene, e.g., an entire therapeutic gene or a functional portion thereof, to a subject in need thereof. For example, in some embodiments, the otoferlin gene is too large to be packaged into a single recombinant vector, e.g., a recombinant AAV vector. Accordingly, in some embodiments, two or more vectors are employed to deliver a therapeutic gene, e.g., an entire therapeutic gene to a subject in need thereof. For example, in some embodiments, a dual vector system is used, wherein each of two vectors comprises a portion of the human otoferlin gene and, when delivered in vivo, the constructs come together to generate a polynucleotide that encodes a full length, functional, otoferlin protein. In some embodiments, one or more strategies is used, for example, (i) a concatemerization-trans-splicing strategy, (ii) a hybrid intronic-homologous recombination-trans-splicing strategy, and (iii) an exonic homologous recombination strategy, as summarized by Pryadkina et al. Meth Clin Devel 2015, 2:15009.

Mammalian Cells

Also provided herein is a cell (e.g., a mammalian cell) that includes any of the nucleic acids, vectors (e.g., at least two different vectors described herein), or compositions described herein. Skilled practitioners will appreciate that the nucleic acids and vectors described herein can be introduced into any mammalian cell. Non-limiting examples of vectors and methods for introducing vectors into mammalian cells are described herein. In some embodiments, the cell is a human cell, a mouse cell, a porcine cell, a rabbit cell, a dog cell, a cat cell, a rat cell, a sheep cell, a cat cell, a horse cell, or a non-human primate cell. In some embodiments, the cell is a specialized cell of the cochlea. In some embodiments, the cell is a cochlear inner hair cell or a cochlear outer hair cell. In some embodiments, the cell is a cochlear inner hair cell. In some embodiments, the cell is a cochlear inner hair cell.

In some embodiments, the mammalian cell is in vitro. In some embodiments, the mammalian cell is present in a mammal. In some embodiments, the mammalian cell is obtained from a subject. In some embodiments, the mammalian cell is an autologous cell obtained from a subject and/or is cultured ex vivo.

Methods of Use

Method of Introduction into Cochlea

Also provided herein is a method of introducing into a cochlea of a mammal (e.g., a human) a therapeutically effective amount of any of the compositions described herein. Also provided are methods of increasing expression of an active otoferlin protein (e.g., a full-length otoferlin protein) in an inner hair cell in a cochlea of a mammal (e.g., a human) that include introducing into the cochlea of the mammal a therapeutically effective amount of any of the compositions described herein. Also provided are methods of treating non-symptomatic sensorineural hearing loss in a subject (e.g., a human) identified as having a defective otoferlin gene, wherein the methods include administering a therapeutically effective amount of any of the compositions described herein into a cochlea of a subject. In some examples, the methods described herein can further include administering a neurotrophic factor to a cochlea of a subject (e.g., at substantially the same time as or before, or after, any of the compositions described herein are administered to the subject). In some examples, the methods described herein can further include administering a cochlear implant to a subject (e.g., at substantially the same time as or before, or after, any of the compositions described herein are administered to the subject).

In some embodiments of any of these methods, the mammal has been previously identified as having a defective otoferlin gene (e.g., an otoferlin gene having a mutation that results in a decrease in the expression and/or activity of an otoferlin protein encoded by the gene). Some embodiments of any of these methods further include, prior to the introducing or administering step, determining that the subject has a defective otoferlin gene. Some embodiments of any of these methods can further include detecting a mutation in an otoferlin gene in a subject. Some embodiments of any of the methods can further include identifying or diagnosing a subject as having non-symptomatic sensorineural hearing loss.

In some embodiments of any of these methods, two or more doses of any of the compositions described herein are introduced or administered into the cochlea of the mammal or subject. Some embodiments of any of these methods can include introducing or administering a first dose of the composition into the cochlea of the mammal or subject, assessing hearing function of the mammal or subject following the introducing or the administering of the first dose, and administering an additional dose of the composition into the cochlea of the mammal or subject found not to have a hearing function within a normal range (e.g., as determined using any test for hearing known in the art).

In some embodiments of any of the methods described herein, the composition can be formulated for intra-cochlear administration. In some embodiments of any of the methods described herein, the compositions described herein can be administered via intra-cochlear administration or local administration. In some embodiments of any of the methods described herein, the compositions are administered through the use of a medical device (e.g., any of the exemplary medical devices described herein).

In some embodiments, intra-cochlear administration can be performed using any of the methods described herein or known in the art. For example, a composition can be administered or introduced into the cochlea using the following surgical technique: first using visualization with a 0 degree, 2.5-mm rigid endoscope, the external auditory canal is cleared and a round knife is used to sharply delineate an approximately 5-mm tympanomeatal flap. The tympanomeatal flap is then elevated and the middle ear is entered posteriorly. The chorda tympani nerve is identified and divided, and a currette is used to remove the scutal bone, exposing the round window membrane. To enhance apical distribution of the administered or introduced composition, a surgical laser may be used to make a small 2-mm fenestration in the oval window to allow for perilymph displacement during trans-round window membrane infusion of the composition. The microinfusion device is then primed and brought into the surgical field. The device is maneuvered to the round window, and the tip is seated within the bony round window overhang to allow for penetration of the membrane by the microneedle(s). The footpedal is engaged to allow for a measured, steady infusion of the composition. The device is then withdrawn and the round window and stapes foot plate are sealed with a gelfoam patch.

In some embodiments, the present disclosure describes a delivery approach that utilizes a minimally invasive, well-accepted surgical technique for accessing the middle ear and/or inner ear through the external auditory canal. The procedure includes opening one of the physical barriers between the middle and inner ear at the oval window, and subsequently using a device disclosed herein, e.g., as shown in FIGS. 82-87 (or microcatheter) to deliver a composition disclosed herein at a controlled flow rate and in a fixed volume, via the round window membrane.

In some embodiments, surgical procedures for mammals (e.g., rodents (e.g., mice, rats, hamsters, or rabbits), primates (e.g., NHP (e.g., macaque, chimpanzees, monkeys, or apes) or humans) may include venting to increase AAV vector transduction rates along the length of the cochlea. In some embodiments, absence of venting during surgery may result in lower AAV vector cochlear cell transduction rates when compared to AAV vector cochlear cell transduction rates following surgeries performed with venting. In some embodiments, venting facilitates transduction rates of about 75-100% of IHCs throughout the cochlea. In some embodiments, venting permits IHC transduction rates of about 50-70%, about 60-80%, about 70-90%, or about 80-100% at the base of the cochlea. In some embodiments, venting permits IHC transduction rates of about 50-70%, about 60-80%, about 70-90%, or about 80-100% at the apex of the cochlea.

A delivery device described herein may be placed in a sterile field of an operating room and the end of a tubing may be removed from the sterile field and connected to a syringe that has been loaded with a composition disclosed herein (e.g., one or more AAV vectors) and mounted in the pump. After appropriate priming of the system in order to remove any air, a needle may then be passed through the middle ear under visualization (surgical microscope, endoscope, and/or distal tip camera). A needle (or microneedle) may be used to puncture the RWM. The needle may be inserted until a stopper contacts the RWM. The device may then be held in that position while a composition disclosed herein is delivered at a controlled flow rate to the inner ear, for a selected duration of time. In some embodiments, the flow rate (or infusion rate) may include a rate of about 30 µL/min, or from about 25 µL/min to about 35 µL/min, or from about 20 µL/min to about 40 µL/min, or from about 20 µL/min to about 70 µL/min, or from about 20 µL/min to about 90 µL/min, or from about 20 µL/min to about 100 µL/min. In some embodiments, the flow rate is about 20 µL/min, about 30 µL/min, about 40 µL/min, about 50 µL/min, about 60 µL/min, about 70 µL/min, about 80 µL/min, about 90 µL/min or about 100 µL/min. In some embodiments, the selected duration of time (that is, the time during which a composition disclosed herein is flowing) may be about 3 minutes, or from about 2.5 minutes to about 3.5 minutes, or from about 2 minutes to about 4 minutes, or from about 1.5 minutes to about 4.5 minutes, or from about 1 minute to about 5 minutes. In some embodiments, the total volume of a composition disclosed herein that flows to the inner ear may be about 0.09 mL, or from about 0.08 mL to about 0.10 mL, or from about 0.07 mL to about 0.11 mL. In some embodiments, the total volume of a composition disclosed herein equates to from about 40% to about 50% of the volume of the inner ear.

Once the delivery has been completed, the device may be removed. In some embodiments, a device described herein, may be configured as a single-use disposable product. In other embodiments, a device described herein may be configured as a multi-use, sterilizable product, for example, with a replaceable and/or sterilizable needle sub-assembly. Single use devices may be appropriately discarded (for example, in a biohazard sharps container) after administration is complete.

In some embodiments, a composition disclosed herein comprises one or a plurality of AAV vectors. In some embodiments, when more than one AAV vector is included in the composition, the AAV vectors are each different. In some embodiments, an AAV vector comprises an OTOF coding region, e.g., as described herein. In some embodiments, a composition comprises an rAAV particle comprising an AAV vector described herein. In some embodiments, the r AAV particle is encapsidated by an Anc80 capsid. In some embodiment, the Anc80 capsid comprises a polypeptide of SEQ ID NO: 109.

Subjects

In some embodiments of any of the methods described herein, the subject or mammal is a rodent, a non-human primate, or a human. In some embodiments of any of the methods described herein, the subject or mammal is an adult, a teenager, a juvenile, a child, a toddler, an infant, or a newborn. In some embodiments of any of the methods described herein, the subject or mammal is 1-5, 1-10, 1-20, 1-30, 1-40, 1-50, 1-60, 1-70, 1-80, 1-90, 1-100, 1-110, 2-5, 2-10, 10-20, 20-30, 30-40, 40-50, 50-60, 60-70, 70-80, 80-90, 90-100, 100-110, 10-30, 10-40, 10-50, 10-60, 10-70, 10-80, 10-90, 10-100, 10-110, 20-40, 20-50, 20-60, 20-70, 20-80, 20-90, 20-100, 20-110, 30-50, 30-60, 30-70, 30-80, 30-90, 30-100, 40-60, 40-70, 40-80, 40-90, 40-100, 50-70, 50-80, 50-90, 50-100, 60-80, 60-90, 60-100, 70-90, 70-100, 70-110, 80-100, 80-110, or 90-110 years of age. In some embodiments of any of the methods described herein, the subject or mammal is 1, 2, 3, 4, 5, 6, 7, 8, 9, 10, or 11 months of age.

In some embodiments of any of the methods described herein, the methods result in improvement in hearing (e.g., any of the metrics for determining improvement in hearing described herein) in a subject in need thereof for at least 10 days, at least 15 days, at least 20 days, at least 25 days, at least 30 days, at least 35 days, at least 40 days, at least 45 days, at least 50 days, at least 55 days, at least 60 days, at least 65 days, at least 70 days, at least 75 days, at least 80 days, at least 85 days, at least 100 days, at least 105 days, at least 110 days, at least 115 days, at least 120 days, at least 5 months, at least 6 months, at least 7 months, at least 8 months, at least 9 months, at least 10 months, at least 11 months, or at least 12 months.

In some embodiments of any of the methods described herein, the subject or mammal has or is at risk of developing non-syndromic sensorineural hearing loss. In some embodiments of any of the methods described herein, the subject or mammal has been previously identified as having a mutation in an otoferlin gene. In some embodiments of any of the methods described herein, the subject or mammal has any of the mutations in an otoferlin gene that are described herein or are known in the art to be associated with non-symptomatic sensorineural hearing loss.

In some embodiments of any of the methods described herein, the subject or mammal has been identified as being a carrier of a mutation in an otoferlin gene (e.g., via genetic testing). In some embodiments of any of the methods described herein, the subject or human has been identified as having a mutation in an otoferlin gene and has been diagnosed with non-symptomatic sensorineural hearing loss. In some embodiments of any of the methods described herein, the subject or human has been identified as having non-symptomatic sensorineural hearing loss.

In some embodiments, successful treatment of non-symptomatic sensorineural hearing loss can be determined in a subject using any of the conventional functional hearing tests known in the art. Non-limiting examples of functional hearing tests are various types of audiometric assays (e.g., pure-tone testing, speech testing, test of the middle ear, auditory brainstem response, and otoacoustic emissions).

Increasing Expression of Active Otoferlin

Also provided herein are methods of increasing expression of an active otoferlin protein (e.g., a full-length otoferlin protein) in a mammalian cell that include introducing any of the compositions described herein into a mammalian cell. In some embodiments of these methods, a mammalian cell is a cochlear inner hair cell. In some embodiments of these methods, a mammalian cell is a human cell (e.g., a human cochlear inner hair cell). In some embodiments of these methods, a mammalian cell is in vitro. In some embodiments of these methods, a mammalian cell is in a mammal. In some embodiments of these methods, a mammalian cell is originally obtained from a mammal and/or is cultured ex vivo. In some embodiments, a mammalian cell has previously been determined to have a defective otoferlin gene.

Methods for introducing any of the compositions described herein into a mammalian cell are known in the art (e.g., via lipofection or through the use of a viral vector, e.g., any of the viral vectors described herein).

In some embodiment, an increase in expression of an active otoferlin protein (e.g., a full-length otoferlin protein) as described herein is, e.g., as compared to a control or to the level of expression of an active otoferlin protein (e.g., a full-length otoferlin protein) prior to the introduction of the vector(s).

Methods of Detecting Otoferlin

Methods of detecting expression and/or activity of otoferlin are known in the art. In some embodiments, the level of expression of an otoferlin protein can be detected directly (e.g., detecting otoferlin protein or detecting otoferlin mRNA). Non-limiting examples of techniques that can be used to detect expression and/or activity of otoferlin directly include: real-time PCR, Western blotting, immunoprecipitation, immunohistochemistry, or immunofluorescence. In some embodiments, expression of an otoferlin protein can be detected indirectly (e.g., through functional hearing tests).

Compositions

Among other things, the present disclosure provides compositions. In some embodiments, a composition comprises a construct as described herein. In some embodiments, a composition comprises one or more constructs as described herein. In some embodiments, a composition comprises a plurality of constructs as described herein. In some embodiments, when more than one construct is included in the composition, the constructs are each different.

In some embodiments, a composition comprises an AAV vector as described herein. In some embodiments, a composition comprises one or more AAV vectors as described herein. In some embodiments, a composition comprises a plurality of AAV vectors. In some embodiments, when more than one AAV vector is included in the composition, the AAV vectors are each different. In some embodiments, an AAV vector comprises an OTOF coding region, e.g., as described herein.

In some embodiments, a composition comprises one or more recombinant AAV (rAAV) particles. In some embodiments, an rAAV particle comprises a recombinant AAV vector (rAAV). In some embodiments, an rAAV particle is encapsidated by an Anc80 capsid. In some embodiments, the Anc80 capsid comprises a polypeptide of SEQ ID NO: 109.

In some embodiments, a composition is or comprises a pharmaceutical composition.

In some embodiments, a composition described herein is in a solution.

Dosing and Volume of Administration

In some embodiments, a composition disclosed herein, e.g., one or a plurality of AAV vectors disclosed herein, is administered as a single dose or as a plurality of doses.

In some embodiments, a composition disclosed herein is administered as a single dose. In some embodiments, a composition disclosed herein is administered as a plurality of doses, e.g., 2, 3, 4, 5, 6, 7, 8, 9 or 10 doses.

In some embodiments, a composition disclosed herein (e.g., a composition comprising one or a plurality of AAV vectors disclosed herein) is administered at a volume of about 0.01 mL, about 0.02 mL, about 0.03 mL, about 0.04 mL, about 0.05 mL, about 0.06 mL, about 0.07 mL, about 0.08 mL, about 0.09 mL, about 1.00 mL, about 1.10 mL, about 1.20 mL, about 1.30 mL, about 1.40 mL, about 1.50 mL, about 1.60 mL, about 1.70 mL, about 1.80 mL, about 1.90 mL, or about 2.00 mL. In some embodiments, a composition disclosed herein is administered at a volume of about 0.01 mL. In some embodiments, a composition disclosed herein is administered at a volume of about 0.02 mL. In some embodiments, a composition disclosed herein is administered at a volume of about 0.03 mL. In some embodiments, a composition disclosed herein is administered at a volume of about 0.04 mL. In some embodiments, a composition disclosed herein is administered at a volume of about 0.05 mL. In some embodiments, a composition disclosed herein is administered at a volume of about 0.06 mL. In some embodiments, a composition disclosed herein is administered at a volume of about 0.07 mL. In some embodiments, a composition disclosed herein is administered at a volume of about 0.08 mL. In some embodiments, a composition disclosed herein is administered at a volume of about 0.09 mL. In some embodiments, a composition disclosed herein is administered at a volume of about 1.00 mL. In some embodiments, a composition disclosed herein is administered at a volume of about 1.10 mL. In some embodiments, a composition disclosed herein is administered at a volume of about 1.20 mL. In some embodiments, a composition disclosed herein is administered at a volume of about 1.30 mL. In some embodiments, a composition disclosed herein is administered at a volume of about 1.40 mL. In some embodiments, a composition disclosed herein is administered at a volume of about 1.50 mL. In some embodiments, a composition disclosed herein is administered at a volume of about 1.60 mL. In some embodiments, a composition disclosed herein is administered at a volume of about 1.70 mL. In some embodiments, a composition disclosed herein is administered at a volume of about 1.80 mL. In some embodiments, a composition disclosed herein is administered at a volume of about 1.90 mL. In some embodiments, a composition disclosed herein is administered at a volume of about 2.00 mL.

In some embodiments, a composition disclosed herein (e.g., a composition comprising one or a plurality of AAV vectors disclosed herein) is administered at a volume of about 0.01 to 2.00 mL, about 0.02 to 1.90 mL, about 0.03 to 1.8 mL, about 0.04 to 1.70 mL, about 0.05 to 1.60 mL, about 0.06 to 1.50 mL, about 0.06 to 1.40 mL, about 0.07 to 1.30 mL, about 0.08 to 1.20 mL, or about 0.09 to 1.10 mL. In some embodiments a composition disclosed herein (e.g., a composition comprising one or a plurality of AAV vectors disclosed herein) is administered at a volume of about 0.01 to 2.00 mL, about 0.02 to 2.00 mL, about 0.03 to 2.00 mL, about 0.04 to 2.00 mL, about 0.05 to 2.00 mL, about 0.06 to 2.00 mL, about 0.07 to 2.00 mL, about 0.08 to 2.00 mL, about 0.09 to 2.00 mL, about 0.01 to 1.90 mL, about 0.01 to 1.80 mL, about 0.01 to 1.70 mL, about 0.01 to 1.60 mL, about 0.01 to 1.50 mL, about 0.01 to 1.40 mL, about 0.01 to 1.30 mL, about 0.01 to 1.20 mL, about 0.01 to 1.10 mL, about 0.01 to 1.00 mL, about 0.01 to 0.09 mL.

Pharmaceutical Compositions and Kits

Pharmaceutical compositions of the present disclosure may comprise a nucleic acid, e.g., one or a plurality of AAV vectors, as described herein, in combination with one or more pharmaceutically or physiologically acceptable carriers, diluents or excipients. In some embodiments, a pharmaceutical composition may comprise one or more AAV vectors, e.g., one or more AAV constructs encapsidated by one or more AAV serotype capsids, as described herein. In some embodiments, a pharmaceutical composition may comprise buffers such as neutral buffered saline, phosphate buffered saline and the like; carbohydrates such as glucose, mannose, sucrose, or dextrans; mannitol; proteins; polypeptides or amino acids such as glycine; antioxidants; chelating agents such as EDTA or glutathione; adjuvants (e.g., aluminum hydroxide); and preservatives. Compositions of the present disclosure are in one aspect formulated for intra-cochlear administration. Compositions of the present disclosure are in one aspect formulated for intravenous administration.

In some embodiments, the therapeutic compositions are formulated for intra-cochlear administration. In some embodiments, the therapeutic compositions are formulated to comprise a lipid nanoparticle. In some embodiments, the therapeutic compositions are formulated to comprise a polymeric nanoparticle. In some embodiments, the therapeutic compositions are formulated to comprise a mini-circle DNA. In some embodiments, the therapeutic compositions are formulated to comprise a CELiD DNA. In some embodiments, the therapeutic compositions are formulated to comprise a synthetic perilymph solution. An exemplary synthetic perilymph solution includes 20-200 mM NaCl; 1-5 mM KCl; 0.1-10 mM $CaCl_2$); 1-10 mM glucose; and 2-50 mM HEPES, with a pH between about 6 and about 9.

In some embodiments, any of the compositions described herein can further include one or more agents that promote the entry of a nucleic acid or any of the vectors described herein into a mammalian cell (e.g., a liposome or cationic lipid). In some embodiments, any of the vectors described herein can be formulated using natural and/or synthetic polymers. Non-limiting examples of polymers that may be included in any of the compositions described herein can include, but are not limited to, DYNAMIC POLYCONJUGATE® (Arrowhead Research Corp., Pasadena, Calif.), formulations from Mirus Bio (Madison, Wis.) and Roche Madison (Madison, Wis.), PhaseRX polymer formulations such as, without limitation, SMARTT POLYMER TECHNOLOGY® (PhaseRX, Seattle, Wash.), DMRI/DOPE, poloxamer, VAXFECTIN® adjuvant from Vical (San Diego, Calif.), chitosan, cyclodextrin from Calando Pharmaceuticals (Pasadena, Calif.), dendrimers and poly (lactic-co-glycolic acid) (PLGA) polymers, RONDEL™ (RNAi/Oligonucleotide Nanoparticle Delivery) polymers (Arrowhead Research Corporation, Pasadena, Calif.), and pH responsive co-block polymers, such as, but not limited to, those produced by PhaseRX (Seattle, Wash.). Many of these polymers have demonstrated efficacy in delivering oligonucleotides in vivo into a mammalian cell (see, e.g., deFougerolles, *Human Gene Ther.* 19:125-132, 2008; Rozema et al., *Proc. Natl. Acad. Sci. U.S.A.* 104:12982-12887, 2007; Rozema et al., *Proc. Natl. Acad. Sci. U.S.A.* 104:12982-12887, 2007; Hu-Lieskovan et al., *Cancer Res.* 65:8984-8982, 2005; Heidel et al., *Proc. Natl. Acad. Sci. U.S.A.* 104:5715-5721, 2007). Any of the compositions described herein can be, e.g., a pharmaceutical composition. In some embodiments, the composition includes a pharmaceutically acceptable carrier (e.g., phosphate buffered saline, saline, or bacteriostatic water). Upon formulation, solutions will be administered in a manner compatible with the dosage formulation and in such amount as is therapeutically effective. The formulations are easily administered in a variety of dosage forms such as injectable solutions, injectable gels, drug-release capsules, and the like.

As used herein, the term "pharmaceutically acceptable carrier" includes solvents, dispersion media, coatings, antibacterial agents, antifungal agents, and the like that are compatible with pharmaceutical administration. Supplementary active compounds can also be incorporated into any of the compositions described herein.

In some embodiments, a single dose of any of the compositions described herein can include a total sum amount of the at least two different vectors of at least 1 ng, at least 2 ng, at least 4 ng, about 6 ng, at least 8 ng, at least 10 ng, at least 20 ng, at least 30 ng, at least 40 ng, at least 50 ng, at least 60 ng, at least 70 ng, at least 80 ng, at least 90 ng, at least 100 ng, at least 200 ng, at least 300 ng, at least 400 ng, at least 500 ng, at least 1 µg, at least 2 µg, at least 4 µg, at least 6 µg, at least 8 µg, at least 10 µg, at least 12 µg, at least 14 µg, at least 16 g, at least 18 ag, at least 20 ag, at least 22 ag, at least 24 µg, at least 26 µg, at least 28 µg, at least 30 µg at least 32 µg, at least 34 µg, at least 36 µg, at least 38 µg, at least 40 g, at least 42 µg, at least 44 µg, at least 46 µg, at least 48 µg, at least 50 µg, at least 52 g, at least 54 µg, at least 56 µg, at least 58 µg, at least 60 µg, at least 62 µg, at least 64 µg, at least 66 µg, at least 68 µg, at least 70 µg, at least 72 µg, at least 74 µg, at least 76 g, at least 78 µg, at least 80 µg, at least 82 µg, at least 84 µg, at least 86 µg, at least 88 g, at least 90 µg, at least 92 µg, at least 94 µg, at least 96 µg, at least 98 µg, at least 100 µg, at least 102 µg, at least 104 µg, at least 106 µg, at least 108 µg, at least 110 µg, at least 112 µg, at least 114 µg, at least 116 µg, at least 118 µg, at least 120 µg, at least 122 µg, at least 124 µg, at least 126 µg, at least 128 µg, at least 130 µg at least 132 µg, at least 134 µg, at least 136 µg, at least 138 µg, at least 140 µg, at least 142 µg, at least 144 µg, at least 146 µg, at least 148 µg, at least 150 µg, at least 152 µg, at least 154 µg, at least 156 µg, at least 158 µg, at least 160 µg, at least 162 µg, at least 164 µg, at least 166 µg, at least 168 µg, at least 170 µg, at least 172 µg, at least 174 µg, at least 176 µg, at least 178 µg, at least 180 µg, at least 182 µg, at least 184 µg, at least 186 µg, at least 188 µg, at least 190 µg, at least 192 µg, at least 194 µg, at least 196 µg, at least 198 µg, or at least 200 µg, e.g., in a buffered solution.

The compositions provided herein can be, e.g., formulated to be compatible with their intended route of administration. A non-limiting example of an intended route of administration is local administration (e.g., intra-cochlear administration).

In some embodiments, the therapeutic compositions are formulated to include a lipid nanoparticle. In some embodiments, the therapeutic compositions are formulated to include a polymeric nanoparticle. In some embodiments, the therapeutic compositions are formulated to comprise a minicircle DNA. In some embodiments, the therapeutic compositions are formulated to comprise a CELiD DNA. In some embodiments, the therapeutic compositions are formulated to comprise a synthetic perilymph solution. An exemplary synthetic perilymph solution includes 20-200 mM NaCl; 1-5 mM KCl; 0.1-10 mM $CaCl_2$; 1-10 mM glucose; 2-50 mM HEPES, having a pH of between about 6 and about 9.

Also provided are kits including any of the compositions described herein. In some embodiments, a kit can include a solid composition (e.g., a lyophilized composition including the at least two different vectors described herein) and a liquid for solubilizing the lyophilized composition. In some embodiments, a kit can include a pre-loaded syringe including any of the compositions described herein.

In some embodiments, a kit includes a vial comprising any of the compositions described herein (e.g., formulated as an aqueous composition, e.g., an aqueous pharmaceutical composition).

In some embodiments, a kit can include instructions for performing any of the methods described herein.

Routes of Administration

The pharmaceutical forms suitable for injectable use include sterile aqueous solutions or dispersions and sterile powders for the extemporaneous preparation of sterile injectable solutions or dispersions. Dispersions may also be prepared in glycerol, liquid polyethylene glycols, and mixtures thereof and in oils. Under ordinary conditions of storage and use, these preparations contain a preservative to prevent the growth of microorganisms. In many cases the form is sterile and fluid to the extent that easy syringability exists. It must be stable under the conditions of manufacture and storage and must be preserved against the contaminating action of microorganisms, such as bacteria and fungi. The carrier can be a solvent or dispersion medium containing, for example, water, ethanol, polyol (e.g., glycerol, propylene glycol, and liquid polyethylene glycol, and the like), suitable mixtures thereof, and/or vegetable oils. Proper fluidity may be maintained, for example, by the use of a coating, such as lecithin, by the maintenance of the required particle size in the case of dispersion and by the use of surfactants. The prevention of the action of microorganisms can be brought about by various antibacterial and antifungal agents, for example, parabens, chlorobutanol, phenol, sorbic acid, thimerosal, and the like. In many cases, it will be preferable to include isotonic agents, for example, sugars or sodium chloride. Prolonged absorption of the injectable compositions can be brought about by the use in the compositions of agents delaying absorption, for example, aluminum monostearate and gelatin.

For administration of an injectable aqueous solution, for example, the solution may be suitably buffered, if necessary, and the liquid diluent first rendered isotonic with sufficient saline or glucose. These particular aqueous solutions are especially suitable for intravenous, intramuscular, subcutaneous and intraperitoneal administration. In this connection, a sterile aqueous medium that can be employed will be known to those of skill in the art. For example, one dosage may be dissolved in 1 ml of isotonic NaCl solution and either added to 1000 ml of hypodermoclysis fluid or injected at the proposed site of infusion, (see for example, "Remington's Pharmaceutical Sciences" 15th Edition, pages 1035-1038 and 1570-1580). Some variation in dosage will necessarily occur depending on the condition of the host. The person responsible for administration will, in any event, determine the appropriate dose for the individual host.

Sterile injectable solutions are prepared by incorporating the active rAAV in the required amount in the appropriate solvent with various of the other ingredients enumerated herein, as required, followed by filtered sterilization. Generally, dispersions are prepared by incorporating the various sterilized active ingredients into a sterile vehicle which contains the basic dispersion medium and the required other ingredients from those enumerated above. In the case of sterile powders for the preparation of sterile injectable solutions, the preferred methods of preparation are vacuum-drying and freeze-drying techniques which yield a powder of the active ingredient plus any additional desired ingredient from a previously sterile-filtered solution thereof.

The rAAV compositions disclosed herein may also be formulated in a neutral or salt form. Pharmaceutically-acceptable salts, include the acid addition salts (formed with the free amino groups of the protein) and which are formed with inorganic acids such as, for example, hydrochloric or phosphoric acids, or such organic acids as acetic, oxalic, tartaric, mandelic, and the like. Salts formed with the free carboxyl groups can also be derived from inorganic bases such as, for example, sodium, potassium, ammonium, calcium, or ferric hydroxides, and such organic bases as isopropylamine, trimethylamine, histidine, procaine and the like. Upon formulation, solutions will be administered in a manner compatible with the dosage formulation and in such amount as is therapeutically effective. The formulations are easily administered in a variety of dosage forms such as injectable solutions, drug-release capsules, and the like.

As used herein, "carrier" includes any and all solvents, dispersion media, vehicles, coatings, diluents, antibacterial and antifungal agents, isotonic and absorption delaying agents, buffers, carrier solutions, suspensions, colloids, and the like. The use of such media and agents for pharmaceutical active substances is well known in the art. Supplementary active ingredients can also be incorporated into the compositions. The phrase "pharmaceutically-acceptable" refers to molecular entities and compositions that do not produce an allergic or similar untoward reaction when administered to a host.

Delivery vehicles such as liposomes, nanocapsules, microparticles, microspheres, lipid particles, vesicles, and the like, may be used for the introduction of the compositions of the present disclosure into suitable host cells. In particular, the rAAV vector delivered transgenes may be formulated for delivery either encapsulated in a lipid particle, a liposome, a vesicle, a nanosphere, or a nanoparticle or the like.

Such formulations may be preferred for the introduction of pharmaceutically acceptable formulations of the nucleic acids or the rAAV constructs disclosed herein. The formation and use of liposomes is generally known to those of skill in the art. Recently, liposomes were developed with improved serum stability and circulation half-times (U.S. Pat. No. 5,741,516). Further, various methods of liposome and liposome like preparations as potential drug carriers have been described (U.S. Pat. Nos. 5,567,434; 5,552,157; 5,565,213; 5,738,868 and 5,795,587).

Liposomes have been used successfully with a number of cell types that are normally resistant to transfection by other procedures. In addition, liposomes are free of the DNA length constraints that are typical of viral-based delivery systems. Liposomes have been used effectively to introduce genes, drugs, radiotherapeutic agents, viruses, transcription factors and allosteric effectors into a variety of cultured cell lines and animals. In addition, several successful clinical trials examining the effectiveness of liposome-mediated drug delivery have been completed.

Liposomes are formed from phospholipids that are dispersed in an aqueous medium and spontaneously form multilamellar concentric bilayer vesicles (also termed multilamellar vesicles (MHLVs). MLVs generally have diameters of from 25 nm to 4 Tm. Sonication of MHLVs results in the formation of small unilamellar vesicles (SUVs) with diameters in the range of 200 to 500.ANG., containing an aqueous solution in the core.

Alternatively, nanocapsule formulations of the rAAV may be used. Nanocapsules can generally entrap substances in a stable and reproducible way. To avoid side effects due to intracellular polymeric overloading, such ultrafine particles (sized around 0.1 Tm) should be designed using polymers able to be degraded in vivo. Biodegradable polyalkyl-cyanoacrylate nanoparticles that meet these requirements are contemplated for use.

In addition to the methods of delivery described above, the following techniques are also contemplated as alternative methods of delivering the rAAV compositions to a host. Sonophoresis (i.e., ultrasound) has been used and described in U.S. Pat. No. 5,656,016 as a device for enhancing the rate and efficacy of drug permeation into and through the circulatory system. Other drug delivery alternatives contemplated are intraosseous injection (U.S. Pat. No. 5,779,708), microchip devices (U.S. Pat. No. 5,797,898), ophthalmic formulations (Bourlais et al., 1998), transdermal matrices (U.S. Pat. Nos. 5,770,219 and 5,783,208) and feedback-controlled delivery (U.S. Pat. No. 5,697,899).

The administration of the subject compositions may be carried out in any convenient manner, including by aerosol inhalation, injection, ingestion, transfusion, implantation or transplantation. The compositions described herein may be administered to a subject trans arterially, subcutaneously, intradermally, intranodally, intramedullary, intramuscularly, by intravenous (i.v.) injection, or intraperitoneally. In one aspect, the nucleic acid compositions of the present disclosure are administered to a subject by intradermal or subcutaneous injection. In one aspect, the nucleic compositions of the present disclosure are administered by i.v. injection.

Devices and Surgical Methods

Provided herein are technologies (e.g., systems, methods, devices, etc.) that may be used, in some embodiments, for treating deafness and other hearing-associated diseases, disorders and conditions. Examples of such technologies are also included in, e.g., WO2017223193 and WO2019084145, each of which is herein incorporated by reference in its entirety. In one aspect, the present disclosure provides therapeutic delivery systems for treating deafness and other hearing-associated diseases, disorders and conditions. In one aspect, provided are therapeutic delivery systems that include i) a medical device capable of creating one or a plurality of incisions in a round window membrane of an inner ear of a human subject in need thereof, and ii) an effective dose of a therapeutic composition comprising one or a plurality of adeno-associated viral (AAV) vectors, wherein the one or the plurality of AAV vectors are capable of constituting a full-length auditory polypeptide messenger RNA in a target cell of the inner ear. In some embodiments, of a means for performing a surgical method, the method comprises the steps of: administering intra-cochlearly to a human subject in need thereof an effective dose of a therapeutic composition of the present disclosure, wherein the therapeutic composition is capable of being administered by using a medical device which comprises: a) a means for creating one or a plurality of incisions in a round window membrane; and b) an effective dose of a therapeutic composition.

Provided herein are surgical methods for treatment of hearing loss. In one aspect, the methods include the steps of: introducing into a cochlea of a human subject a first incision at a first incision point; and administering intra-cochlearly an effective dose of a therapeutic composition (e.g., any of the compositions described herein) as provided herein. In one embodiment, a therapeutic composition (e.g., any of the compositions described herein) is administered to the subject at a first incision point. In one embodiment, a therapeutic composition is administered to a subject into or through a first incision. In one embodiment, a therapeutic composition is administered to a subject into or through a cochlea oval window membrane. In one embodiment, a therapeutic composition is administered to a subject into or through a cochlea round window membrane.

In some embodiments, a composition disclosed herein can be administered to a subject with a surgical procedure. In some embodiments, administration, e.g., via a surgical procedure, comprises injecting a composition disclosed herein via a delivery device as described herein into the inner ear. In some embodiments, a surgical procedure disclosed herein comprises performing a transcanal tympanotomy; performing a laser-assisted micro-stapedotomy; and injecting a composition disclosed herein via a delivery device as described herein into the inner ear.

In some embodiments, a surgical procedure comprises performing a transcanal tympanotomy; performing a laser-assisted micro-stapedotomy; injecting a composition disclosed herein via a delivery device as described herein into the inner ear; applying sealant around the round window and/or an oval window of the subject; and lowering a tympanomeatal flap of the subject to the anatomical position.

In some embodiments, a surgical procedure comprises performing a transcanal tympanotomy; preparing a round window of the subject; performing a laser-assisted micro-stapedotomy; preparing both a delivery device as described herein and a composition disclosed herein for delivery to the inner ear; injecting a composition disclosed herein via the delivery device into the inner ear; applying sealant around the round window and/or an oval window of the subject; and lowering a tympanomeatal flap of the subject to the anatomical position.

In some embodiments, performing a laser-assisted micro-stapedotomy includes using a KTP otologic laser and/or a C02 otologic laser.

In some embodiments, a composition comprises one or a plurality of AAV vectors. In some embodiments, when more than one AAV vector is included in the composition, the AAV vectors are each different. In some embodiments, an AAV vector comprises an OTOF coding region, e.g., as described herein. In some embodiments, a composition comprises an rAAV particle comprising an AAV vector described herein. In some embodiments, the r AAV particle is encapsidated by an Anc80 capsid. In some embodiment, the Anc80 capsid comprises a polypeptide of SEQ ID NO: 109.

For example, in one embodiment, a therapeutic composition is administered using a medical device capable of creating a plurality of incisions in a round window membrane. In one embodiment, a medical device includes a plurality of micro-needles. In one embodiment, a medical device includes a plurality of micro-needles including a generally circular first aspect, wherein each micro-needle has a diameter of at least about 10 microns. In one embodiment, a medical device includes a base and/or a reservoir capable of holding a therapeutic composition. In one embodiment, a medical device includes a plurality of hollow micro-needles individually including a lumen capable of transferring a therapeutic composition. In one embodiment, a medical device includes a means for generating at least a partial vacuum.

As another example, a composition disclosed herein is administered using a device and/or system specifically designed for intracochlear route of administration. In some embodiments, design elements of a device described herein may include: maintenance of sterility of injected fluid; minimization of air bubbles introduced to the inner ear; ability to precisely deliver small volumes at a controlled rate; delivery through the external auditory canal by the surgeon; minimization of damage to the round window membrane (RWM), or to inner ear, e.g., cochlear structures beyond the RWM; and/or minimization of injected fluid leaking back out through the RWM.

The devices, systems, and methods provided herein also describe the potential for delivering a composition safely and efficiently into the inner ear, in order to treat conditions and disorders that would benefit from delivery of a composition disclosed herein to the inner ear, including, but not limited to, hearing disorders, e.g., as described herein. As another example, by placing a vent in the stapes footplate and injecting through the RWM, a composition disclosed herein is dispersed throughout the cochlea with minimal dilution at the site of action. The development of the described devices allows the surgical administration procedure to be performed through the external auditory canal in humans. The described devices can be removed from the ear following infusion of an amount of fluid into the perilymph of the cochlea. In subjects, the device may be advanced through the external auditory canal, either under surgical microscopic control or along with an endoscope.

An exemplary device for use in any of the methods disclosed herein is described in FIGS. 81-84. FIG. 81 illustrates an exemplary device 10 for delivering fluid to an inner ear. Device 10 includes a knurled handle 12, and a distal handle adhesive 14 (for example, an epoxy such as loctite 4014) that couples to a telescoping hypotube needle support 24. The knurled handle 12 (or handle portion) may include kurling features and/or grooves to enhance the grip. The knurled handle 12 (or handle portion) may be from about 5 mm to about 15 mm thick or from about 5 mm to about 12 mm thick, or from about 6 mm to about 10 mm thick, or from about 6 mm to about 9 mm thick, or from about 7 mm to about 8 mm thick. The knurled handle 12 (or handle portion) may be hollow such that fluid may pass through the device 10 during use. The device 10 may also include a proximal handle adhesive 16 at a proximal end 18 of the knurled handle 12, a needle sub-assembly 26 (shown in FIG. 82) with stopper 28 (shown in FIG. 82) at a distal end 20 of the device 10, and a strain relief feature 22. Strain relief feature 22 may be composed of a Santoprene material, a Pebax material, a polyurethane material, a silicone material, a nylon material, and/or a thermoplastic elastomer. The telescoping hypotube needle support 24 surrounds and supports a bent needle 38 (shown in FIG. 82) disposed therewithin.

Referring still to FIG. 81, the stopper 28 may be composed of a thermoplastic material or plastic polymer (such as a UV-cured polymer), as well as other suitable materials, and may be used to prevent the bent needle 38 from being inserted too far into the ear canal (for example, to prevent insertion of bent needle 38 into the lateral wall or other inner ear structure). Device 10 also may include a tapered portion 23 disposed between the knurled handle 12 and the distal handle adhesive 14 that is coupled to the telescoping hypotube needle support 24. The knurled handle 12 (or handle portion) may include the tapered portion 23 at the distal end of the handle portion 12. Device 10 may also include tubing 36 fluidly connected to the proximal end 16 the device 10 and acts as a fluid inlet line connecting the device to upstream components (for example, a pump, a syringe, and/or upstream components which, in some embodiments, may be coupled to a control system and/or power supply (not shown)). In some embodiments, the bent needle 38 (shown in FIG. 82) extends from the distal end 20, through the telescoping hypotube needle support 24, through the tapered portion 23, through the knurled handle 12, and through the strain relief feature 22 and fluidly connects directly to the tubing 36. In other embodiments, the bent needle 38 fluidly connects with the hollow interior of the knurled handle (for example, via the telescoping hypotube needle support 24) which in turn fluidly connects at a proximal end 16 with tubing 36. In embodiments where the bent needle 38 does not extend all the way through the interior of the device 10, the contact area (for example, between overlapping nested hypotubes 42), the tolerances, and/or sealants between interfacing components must be sufficient to prevent therapeutic fluid from leaking out of the device 10 (which operates at a relatively low pressure (for example, from about 1 Pascal to about 50 Pa, or from about 2 Pa to about 20 Pa, or from about 3 Pa to about 10 Pa)).

FIG. 82 illustrates a sideview of the bent needle sub-assembly 26, according to aspects of the present disclosed embodiments. Bent needle sub-assembly 26 includes a needle 38 that has a bent portion 32. Bent needle sub-assembly 26 may also include a stopper 28 coupled to the bent portion 32. The bent portion 32 includes an angled tip 34 at the distal end 20 of the device 10 for piercing a membrane of the ear (for example, the RWM). The needle 38, bent portion 32, and angled top 34 are hollow such that fluid may flow therethrough. The angle 46 (as shown in FIG. 84) of the bent portion 32 may vary. A stopper 28 geometry may be cyclidrical, disk-shaped, annulus-shaped, dome-shaped, and/or other suitable shapes. Stopper 28 may be molded into place onto bent portion 32. For example, stopper 28 may be positioned concentrically around the bent portion 32 using adhesives or compression fitting. Examples of adhesives include an UV cure adhesive (such as Dymax 203A-CTH-F-T), elastomer adhesives, thermoset adhesives (such as epoxy or polyurthethane), or emulsion adhesives (such as polyvinyl acetate). Stopper 28 fits concentrically around the bent portion 32 such that angled tip 34 is inserted into the ear at a desired insertion depth. The bent needle 38 may be formed from a straight needle using incremental forming, as well as other suitable techniques.

FIG. 83 illustrates a perspective view of exemplary device 10 for delivering fluid to an inner ear. Tubing 36 may be from about 1300 mm in length (dimension 11 in FIG. 83) to about 1600 mm, or from about 1400 mm to about 1500 mm, or from about 1430 mm to about 1450 mm. Strain release feature 22 may be from about 25 mm to about 30 mm in length (dimension 15 in FIG. 83), or from about 20 mm to about 35 mm in length. Handle 12 may be about 155.4 mm in length (dimension 13 in FIG. 83), or from about 150 mm to about 160 mm, or from about 140 mm to about 170 mm. The telescoping hypotube needle support 24 may have two or more nested hypotubes, for example three nested hypotubes 42A, 42B, and 42C, or four nested hypotubes 42A, 42B, 42C, and 42D. The total length of hypotubes 42A, 42B, 42C and tip assembly 26 (dimension 17 in FIG. 83) may be from about 25 mm to about 45 mm, or from about 30 mm to about 40 mm, or about 35 mm. In addition, telescoping hypotube needle support 24 may have a length of about 36 mm, or from about 25 mm to about 45 mm, or form about 30 mm to about 40 mm. The three nested hypotubes 42A, 42B, and 42C each may have a length of 3.5 mm, 8.0 mm, and 19.8 mm, respectively, plus or minus about 20%. The inner-most nested hypotube (or most narrow portion) of the telescoping hypotube needle support 24 may be concentrically disposed around needle 38.

FIG. 84 illustrates a perspective view of bent needle sub-assembly 26 coupled to the distal end 20 of device 10, according to aspects of the present disclosed embodiments. As shown in FIG. 84, bent needle sub-assembly 26 may include a needle 38 coupled to a bent portion 32. In other embodiments, the bent needle 38 may be a single needle (for example, a straight needle that is then bent such that it includes the desired angle 46). Needle 38 may be a 33-gauge needle, or may include a gauge from about 32 to about 34, or from about 31 to 35. At finer gauges, care must be taken to ensure tubing 36 is not kinked or damaged. Needle 38 may be attached to handle 12 for safe and accurate placement of needle 38 into the inner ear. As shown in FIG. 84, bent needle sub-assembly 26 may also include a stopper 28 disposed around bent portion 32. FIG. 84 also shows that bent portion 32 may include an angled tip 34 for piercing a membrane of the ear (for example, the RWM). Stopper 28 may have a height 48 of about 0.5 mm, or from about 0.4 mm to about 0.6 mm, or from about 0.3 mm to about 0.7 mm. Bent portion 32 may have a length 52 of about 1.45 mm, or from about 1.35 mm to about 1.55 mm, or from about 1.2 mm to about 1.7 mm. In other embodiments, the bent portion 32 may have a length greater than 2.0 mm such that the distance between the distal end of the stopper 28 and the distal end of the angled tip 34 is from about 0.5 mm to about 1.7 mm, or from about 0.6 mm to about 1.5 mm, or from about 0.7 mm to about 1.3 mm, or from about 0.8 mm to about 1.2 mm. FIG. 84 shows that stopper 28 may have a geometry that is cyclidrical, disk-shaped, and/or dome-shaped. A person of ordinary skill will appreciate that other geometries could be used.

The disclosure is further described in detail by reference to the following experimental examples. These examples are provided for purposes of illustration only, and are not intended to be limiting unless otherwise specified. Thus, the disclosure should in no way be construed as being limited to the following examples, but rather should be construed to encompass any and all variations that become evident as a result of the teaching provided herein.

Other assays, including those described in the Example section herein as well as those that are known in the art, can also be used to evaluate the auditory polypeptide nucleic acids and nucleic acid constructs of the disclosure.

Without further description, it is believed that one of ordinary skill in the art can, using the preceding description and the following illustrative examples, make and utilize the compounds of the present disclosure and practice the claimed methods. The following working examples specifically point out various aspects of the present disclosure, and are not to be construed as limiting in any way the remainder of the disclosure.

EXAMPLES

Example 1: Characterization of Human Otoferlin Gene, Homologs, Orthologs

The otoferlin gene and the corresponding mRNA are provided below.

Example 2: Construction of Viral Vectors

Recombinant AAV is generated by transfection with an adenovirus-free method as used by Xiao et al. *J Virol* 1999, 73(5):3994-4003. The cis plasmids with AAV ITRs, the trans plasmid with AAV Rep and Cap genes, and a helper plasmid with an essential region from an adenovirus genome are co-transfected in 293 cells in a ratio of 1:1:2. The AAV vectors used here express human otoferlin or mouse otoferlin under multiple dual vector strategies using the constructs described below. AAV serotypes 1, 2, 3, 4, 5, 6, 7, 8, 9, rh8, rh10, rh39, rh43, and Anc80 are each prepared to encapsulate three sets of otoferlin constructs to test (i) a concatemerization-trans-splicing strategy, (ii) a hybrid intronic-homologous recombination-trans-splicing strategy, and (iii) an exonic homologous recombination strategy, as summarized by Pryadkina et al. *Meth Clin Devel* 2015, 2:15009, Example 3: Cloning OTOF Components Oligo-dT and random-primed cDNA libraries are constructed from poly(A)+ mRNA of human total fetus, adult brain, heart, kidney, and murine fetal heart as described by Yasunaga et al. *Am J Genet* 2000, 67:591-600. RACE-PCR experiments are performed on these libraries using linker primers and a series of primers selected from the otoferlin cDNA sequence. The PCR products are directly cloned into pGEM-T Easy vector and sequenced. To isolate the human cDNA long form (7 kb), a reverse primer (5'-TT-CACCTGGGCCCGCA-GCATCCT-3' (SEQ ID NO: 29)) is designed from the sequence encoding aa 63-70 of the initially reported short form of otoferlin (Yasunaga et al., 1999) (GenBank 107403).

Total RNAs are extracted from mouse cochlea using the methods described in Strenzke et al., *EMBO J.* 35(23):2519-2535, 2016. RT-PCR experiments are performed in various murine and human RNA sources, according to the GeneAmp RNA PCR kit. Two primer pairs are used to reconstitute the murine cDNAs derived from the brain and the cochlea, one from the exon 1 5'-UTR (5'-AGGCGTGTGAGC-CACACTCCACCA-3' (SEQ ID NO: 30)) and exon 22 (5'-CATAACCTCAGCTTGTCCCGAACA-3' (SEQ ID NO: 31)), and the other from the exon 18-19 junction (5'-GGCCCCAGATCACGGACAGGAAC-3' (SEQ ID NO: 32)) and exon 48 3'-UTR (5'-GGCCAGTACACCTGATT-CACACT-3' (SEQ ID NO: 33)). To reconstitute the entire 5' part of the human brain cDNA long form, primers derived from the 5'-UTR exon 1 (5'-GGAG-GAGGCAGCGGCAGAGAAGA-3' (SEQ ID NO: 34)) and exon 22 (5'-TTCACCTGGGCCCGCAGCATCCT-3' (SEQ ID NO: 35)) are used.

For the concatemerization-trans-splicing strategy, two cassettes are composed such that the 5' cassette includes a synthetic hair cell-oriented promoter, a chimeric intron (β-globin), a consensus Kozak sequence, the exons 1 to 26 of otoferlin and the half intron 26 of otoferlin (representing 3,836 bp, or the 3,494 bp of otoferlin cDNA corresponding to exons 1 through 26, plus the first 342 bp of intron 26), and the 3' cassette includes the second half of intron 26 (342 bp), exons 27 to 48 (3,843 bp) of otoferlin, and a polyadenylation signal sequence. In some examples, the a hair cell-oriented promoter is not required for expression of an otoferlin protein in an auditory inner hair cell. For the intronic-homologous recombination-splicing strategy, the cassettes from the concatemerization-splicing strategy described above are modified such that the full length intron 26 of otoferlin is added in the place of the half intron 26 in both plasmids.

For the exonic homologous recombination strategy, the two cassettes are composed such that the 5' cassette includes a hair cell-oriented promoter, a chimeric intron, a consensus Kozak sequence and the exons 1 to 28 (the first 3,776 bp of the otoferlin cDNA), and the 3' cassette includes the exons 23 to 48 (the final 4,446 bp of the otoferlin cDNA) and a polyadenylation signal sequence. The region of homology between the two cassettes is 885 bp.

Example 4: Generating and Purifying Viral Particles

Recombinant AAV-1 is produced using a triple transfection protocol and purified by two sequential cesium chloride (CsCl) density gradients, as described by Pryadkina et al. *Mol Ther* 2015, 2:15009. At the end of second centrifugation, 11 fractions of 500 µl are recovered from the CsCl Density Gradient tube and purified through dialysis in 1×PBS. The fractions are analyzed by dot blot to determine those containing rAAV genomes. The viral genome number (vg) of each preparation is determined by quantitative real-time PCR-based titration method using primers and probe corresponding to the ITR region of the AAV vector genome (Bartoli et al. Gene Ther 2006, 13:20-28).

Example 5: Formulation of Viral Particles

AAV produced at a titer of 1e14 vg/mL is prepared at dilutions of 3.2e13, 1.0e13, 3.2e12, 1.0e12 vg/mL in artificial perilymph. Artificial perilymph is prepared by combining the following reagents, in mM: NaCl, 120; KCl, 3.5; $CaCl_2$, 1.5; glucose, 5.5; HEPES, 20. The artificial perilymphis titrated with NaOH to adjust its pH to 7.5 (total Na concentration of 130 mM) (Chen et al. J Controlled Rel 2005, 110:1-19).

Example 6: In Vitro Demonstration of OTOF mRNA and Protein Production (Anti-OTOF Antibody)

To confirm the AAV-OTOF vectors are capable of successfully transducing mammalian cells in vitro, human retinal epithelial cells and neonate mouse cochlear explants are incubated with AAV-OTOF at titers of 3.2e13, 1.0e13, 3.2e12, 1.0e12 viral genome-containing particles (vg/mL) and assayed for levels of otoferlin DNA, mRNA and protein as described previously (Duncker et al., 2013 *J Neurosci* 33(22):9508-9519. Antibodies against mouse otoferlin are obtained from Abcam and used as described by Engel et al., 2006 *Neurosci* 143:837-849.

Example 7: Exemplary Device Description

The AAV-OTOF formulation is delivered to the cochlea using a specialized microcatheter designed for consistent and safe penetration of the RWM. The microcatheter is shaped such that the surgeon performing the delivery procedure can enter the middle ear cavity via the external auditory canal and contact the end of the microcatheter with the RWM. The distal end of the microcatheter is comprised of at least one microneedle with diameter of between 10 and 1,000 microns, which produce perforations in the RWM that are sufficient to allow AAV-OTOF to enter the cochlear perilymph of the scala tympani at a rate of approximately 1 µL/min, but heal without surgical repair. The remaining portion of the microcatheter, proximal to the microneedle(s), is loaded with the AAV-OTOF/artificial perilymph formulation at a titer of approximately 1e13 vg/mL. The proximal end of the microcatheter is connected to a micromanipulator that allows for precise, low volume infusions of approximately 1 TL/min.

Example 8: Animal Model 1: Aged Mice

Otoferlin rescue with cochlear delivery of AAV-OTOF is assessed in three OTOF knockout mouse models (mouse models as described in Longo-Guess et al. *Hearing Res* 2007, 234(1-2):21-28; Roux et al. Cell 2006, 127:277-289; and Reisinger et al., *J. Neurosci.* 31(13):4886-4895, 2011). Rescue experiments are tested in neonate (P1), juvenile (P6 or P12) and adult (P42) mice, in order to evaluate the postnatal treatment window relative to stage of cochlear development.

Baseline auditory brainstem response (ABR) and distortion product optoacoustic emissions (DPOAEs) are measured in the juvenile and adult mice (n=32), bilaterally, to assess pre-treatment inner hair cell (IHC) and outer hair cell (OHC) function. All animals are expected to display the characteristic audiometric profile of otoferlin dysfunction—i.e., abnormal ABRs across tested sound frequencies but normal DPOAEs, indicative of dysfunctional IHC signal transduction and normal OHC function (Yasunaga et al. 2000, *Am J Hum Genet* 67:591-600).

Following baseline ABR and DPOAE measurements, 0.3 uL of AAV1-OTOF at titers of 1.0e13, 3.2e12, and 1.0e12 vg/mL is injected into the left scala tympani of the juvenile and adult mice (n=32), as described below. Equivalent titers are injected in the left scala tympani of the neonatal mice, but at a volume of 0.2 uL (n=16) (surgical procedure described below). Each animals' right ear is left as an untreated control. ABR and DPOAE measurements are taken again bilaterally in the juvenile and adult animals 1, 5 and 10 days following the surgical procedure. At 4 weeks (n=24) and 12 weeks (n=24) post-procedure, additional bilateral ABR and DPOAE measurements are taken from all animals in the neonate, juvenile and adult groups (total n=48), and the animals are subsequently sacrificed and their cochleae removed.

In half of the sacrificed animals (n=4 from each of the 4 week and 12 week post-treatment groups), immunostaining is performed to identify hair cell structures and to assess OTOF protein expression along the cochlear sensory epithelium. Antibodies against markers for hair cells (Myo7a), supporting cells (Sox2) and otoferlin are used as described previously (Duncker et al. 2013, *J Neurosci* 33(22):9508-9519. At the basal, middle and apical turns of the organ of corti, total numbers of hair cells and those hair cells expressing OTOF were counted within 200 um regions; the entire length of the organ of corti was divided into three pieces of equal length, designated the basal, middle and apical regions.

In the remaining half of the sacrificed animals (remaining 4 animals from each of the 4 week and 12 week post-treatment groups), cochlear tissue samples are collected from the same basal, middle and apical regions as described above, and assayed for otoferlin mRNA transcript as described previously (Duncker et al. 2013, *J Neurosci* 33(22):9508-9519, Heidrych et al. 2008, *Hum Mol Genet* 17:3814-3821, Heidrych et al., 2009, *Hum Mol Genet* 18:2779-2790).

Example 9: Animal Model 1A: Surgical Method in Aged Mice

AAV-OTOF prepared in artificial perilymph is administered to the scala tympani in mice as described by Shu et al. 2016 (Shu Yilai, Tao Yong, Wang Zhengmin, Tang Yong, Li Huawei, Dai Pu, Gao Guanping, and Chen Zheng-Yi. Human Gene Therapy. June 2016, ahead of print. doi: 10.1089/hum.2016.053). Six-week-old male mice are anesthetized using an intraperitoneal injection of xylazine (20 mg/kg) and ketamine (100 mg/kg). Body temperature is maintained at 37° C. using an electric heating pad. An incision is made from the right post-auricular region and the tympanic bulla is exposed. The bulla is perforated with a surgical needle and the small hole is expanded to provide access to the cochlea. The bone of the cochlear lateral wall of the scala tympani is thinned with a dental drill so that the membranous lateral wall is left intact. A Nanoliter Microinjection System in conjunction with glass micropipette is used to deliver a total of approximately 300 nL of AAV-OTOF in artificial perilymph to the scala tympani at a rate of 2 nL/second. The glass micropipette is left in place for 5 minutes post-injection. Following cochleostomy and injection, the opening in the tympanic bulla is sealed with dental cement, and the muscle and skin are sutured. The mice are allowed to awaken from anesthesia and their pain is controlled with 0.15 mg/kg buprenorphine hydrochloride for 3 days.

Example 10: Animal Model 2: Reciprocating Micropump in Guinea Pig

Surgical Procedure

AAV-OTOF prepared in artificial perilymph is administered to guinea pigs to assess distribution and toxicity following intracochlear delivery with a reciprocating micropump as described by Tandon et al. *Lab Chip* 2015 (DOI: 10.1039/c51c01396h). Male guinea pigs weighing approximately 350 g each (n=16) are anesthetized with a combination of pentobarbital sodium (Nembutal; 25 mg kg-1, injected intraperitoneally), fentanyl (0.2 mg kg-1, intramuscularly), and haloperidol (10 mg kg-1, intramuscularly). Lidocaine with epinephrine is given subcutaneously at the incision site as a topical anesthetic. Using a dorsal approach, a 5 mm diameter hole is made in the bulla and a cochleostomy is created approximately 0.5 mm distal to the round window membrane. The cannula of the micropump (described below) is inserted into the cochleostomy, threaded into the cochlea 3 mm apically, and glued to the bulla with a common cyanoacrylate glue. For compound action potential (CAP) measurements, a perfluoroalkoxy-alkane-insulated silver wire electrode (203 µm uncoated diameter) is inserted near the round window niche and glued to the bulla.

Procedures for measurement of distortion product otoacoustic emissions (DPOAEs) and CAPs are performed as previously described in Tandon et al. *Biomed Microdevices* 2015, 17:3-21. DPOAEs are measured before and after the cochleostomy procedure at the characteristic frequencies: 32, 24, 16, 12, 8, 5.6, 4, and 2.78 kHz in order to monitor any damage that occurs as a result of the surgery.

Micropump Description

AAV-OTOF at a maximum titer of 1e14 vg/mL is administered to the guinea pig using a micropump as described by Tandon et al. *Lab Chip* 2015 (DOI: 10.1039/c51c01396h). The micropump system has 4 selectable ports. These ports are connected to: (i) a large fluidic capacitor used for artificial perilymph storage; (ii) an outlet that connects to the cochlea; (iii) the outlet from an integrated AAV-OTOF reservoir; (iv) the inlet to the integrated AAV-OTOF reservoir. Each port is fluidically connected to a central pump chamber, and each is individually addressed with a valve. The sequence of events for reciprocating AAV-OTOF delivery is as follows: (i) an internal AAV-OTOF-refresh loop is run, transferring AAV-OTOF from the AAV-OTOF reservoir into the main infuse-withdraw line; (ii) AAV-OTOF is infused into the cochlea and some artificial perilymph is drained from the artificial perilymph storage capacitor; (iii) the first two steps can be repeated several times for additional doses; (iv) after the AAV-OTOF has been allowed to diffuse for some time, a volume of perilymph is withdrawn from the cochlea that is equal to the volume infused in steps (i)-(iii), refilling the artificial perilymph storage capacitor. This process results in net delivery of drug with zero net fluid volume added to the cochlea.

The fluidic capacitors in the micropump are cylindrical chambers whose ceilings are a thin (25.4 m), flexible, polyimide membrane. The pump chamber has a diameter of 3.5 mm, the fluidic storage capacitor has a diameter of 14 mm, and all of the remaining capacitors have diameters of 4 mm. The same membrane is deflected to block flow at each of the valves. The valve chambers have diameters of 3.1 mm. The serpentine channel that comprises the drug reservoir has a square cross section of width 762 m and a length of 410 mm for a total volume of 238 µL. All of the other microchannels in the pump have a width of 400 µm and a height of 254 µm.

Acute Drug Delivery in Guinea Pigs

The micropump is loaded with AAV-OTOF and artificial perilymph, and the cannula inserted into a cochleostomy made in the region of the cochlea between the locations with characteristic frequency sensitivity of 24 and 32 kHz, and threaded apically 3 mm, terminating in the 12-16 kHz region. Baseline DPOAE and CAP hearing tests are performed prior to the start of AAV-OTOF/artificial perilymph infusion. The pump is then activated and approximately 1 µL of artificial perilymph is infused every 5 min until a total of approximately 10 µL of artificial perilymph is delivered to the cochlea. After a 20 min wait time, approximately 10 µL of perilymph is withdrawn from the cochlea. AAV-OTOF delivery is then initiated at a rate of approximately 1 µL every 5 min until a total of approximately 10 µL of fluid is delivered.

Animals are sacrificed at 1 week, 1 month, 3 months, and 6 months post-treatment (n=4 per group) and their *cochleae* extracted. Extent of AAV transduction and OTOF expression along the organ of Corti is assessed via immunostaining with anti-OTOF antibodies. Antibodies against markers for hair cells (Myo7a) and supporting cells (Sox2) are used to quantify IHCs, OHCs, supporting cells and stereocilia morphology. Annexin V staining is used to assess evidence of apoptosis in cells along the cochlear sensory epithelium.

Example 11: Animal Model 3: Large Animal Tox in Sheep

AAV-OTOF prepared in artificial perilymph is administered to juvenile sheep to assess distribution and toxicity following delivery to the cochlea via trans-RWM infusion. Baseline auditory brainstem response (ABR) and distortion product optoacoustic emissions (DPOAEs) are measured in female sheep at 3 months of age (n=40), bilaterally, to assess pre-treatment inner hair cell (IHC) and outer hair cell (OHC) function. Following baseline ABR and DPOAE measurements, 20 uL of AAV1-OTOF at titers of 1.0e14, 3.2e13, 1.0e13 and 3.2e12 vg/mL is injected into the left scala tympani of the sheep (n=10 per group). Each animal's right ear is left as an untreated control. ABR and DPOAE measurements are taken again bilaterally 1, 5 and 10 days following the surgical procedure. At 6 months post-procedure, additional bilateral ABR and DPOAE measurements are taken from all animals, and the animals are subsequently sacrificed and their *cochleae* removed.

In half of the sacrificed animals (n=5 from each of the dose cohorts), immunostaining is performed to identify hair cell structures and to assess OTOF protein expression along the cochlear sensory epithelium. Antibodies against markers for hair cells (Myo7a), supporting cells (Sox2) and otoferlin are used as described previously (Duncker et al. 2013, *J Neurosci* 33(22):9508-9519). At the basal, middle and apical turns of the organ of corti, total numbers of hair cells and those hair cells expressing OTOF are counted within 200 um regions.

In the remaining half of the sacrificed animals (remaining 5 animals from each dose cohort), cochlear tissue samples are collected from the same basal, middle and apical regions as described above, and assayed for otoferlin mRNA transcript as described previously (Duncker et al. 2013, *J Neurosci* 33(22):9508-9519, Heidrych et al. 2008, *Hum Mol Genet* 17:3814-3821, Heidrych et al., 2009, *Hum Mol Genet* 18:2779-2790).

Example 12: Animal Model 3A: CRISPR Generated Transgenic Large Animal Model (Sheep)

Generation of Plasmid Co-Expressing Cas9 and sgRNA

The pX330-U6-Chimeric_BB-CBh-hSpCas9 plasmid (Addgene plasmid #42230) is digested with BsbI, dephosphorylated using Antartic Phosphatase, and the linearized vector is gel purified. To generate the bicistronic vector (pX330-cas9-OTOF) expressing Cas9 and sgRNA against OTOF, a pair of oligos for targeting otoferlin exon 1 is annealed, phosphorylated and ligated to a linearized vector (Cong et al. 2013 *Science* 339(6121):819-23).

Genome Editing Assay in Cells

The A15 astroglial sheep cell line (Vilette et al., 2000 *In Vitro Cell Dev Biol Anim* 36(1):45-9) is maintained in DMEM in 10% Fetal Bovine Serum, 2 mM glutamine, 1% sodium pyruvate and 1% penicillin/streptomycin. Cells are transfected in 24-well plates with 2 µg of pX330-cas9-OTOF co-expressing Cas9 and sgRNA against otoferlin using lipofectamine LTX reagent. Three days later, genomic DNA from transfected cells is extracted and quantified using a NanoDrop2000 spectrophotometer, measuring A2601A280 and A2601A230 Ratios to Account for Sample Purity Gene mutation activity of sgRNA sequence at the target locus of OTOF exon 1 is quantified using the T7EI mismatch detection assay. DNA sequence of interest is PCR-amplified with a high-fidelity polymerase (Herculase II fusion polymerase) using specific primers. The resultant PCR product is then denatured and slowly re-annealed (95° C., 2 min; 95° C. to 85° C., −2° C./sec; 85° C. to 25° C., −1° C./sec) to produce homoduplex/heteroduplex mix. This is then digested by 5 U of T7EI restriction enzyme at 37° C. for 30 minutes. Digestion products are separated by 2% agarose gel electrophoresis. The ratio of cleaved to uncleaved products is used to calculate NHEJ frequency as previously described using Image J software (Menoret et al. 2011 *Advanced protocols for Animal Transgenesis. An ISTT Manual.* Heidelberg: Springer. p117-36). NHEJ frequency is calculated as % gene modification=100×(1−(1−fraction cleaved)^(½).

Production of sgRNA and Cas9 mRNA

As described previously (Bellec et al. 2015, Current Gene Ther), T7 promoter is added to sgRNA template by PCR amplification of pX330-cas9-OTOF plasmid. The PCR product is purified using NucleoSpin Gel and PCR Cleanup. It is used as the template for in vitro transcription using MEGAshortscript T7 kit according to the manufacturer's manual. Following completion of transcription, DNase I treatment is performed.

The Cas9 mRNA is transcribed using PmeI-digested Cas9 expression JDS246 plasmid (Addgene plasmid #43861) and the mMESSAGE mMACHINE T7 ULTRA Transcription Kit according to the manufacturer's manual. Following completion of transcription, the poly(A) tailing reaction and DNase I treatment are performed. Both the Cas9 mRNA and the sgRNAs are purified using MEGAclear kit and eluted in elution buffer.

In Vitro Production of Embryos

The embryos are produced by in vitro fertilization according to routine procedure as described previously (Crispo et al. 2014 *Transgenic Res,* 24(1):31-41). Briefly, ovaries from slaughterhouse are transported to the laboratory and cumulus oocyte complexes (COCs) are aspirated in recovery medium. The selected COCs are placed in maturation medium for 24 h in 5% C02 in humidified air atmosphere at 39° C. Then, expanded COCs are inseminated in 100 l drops with 1×106 dose of frozen-thawed semen selected by ascendant migration on a swim up method. Fertilization is carried out in 5% CO2 with humidified atmosphere at 39° C. for 22 h.

Microinjection into Zygotes

Soon after fertilization, 572 presumptive zygotes are randomly assigned to three experimental groups to be microinjected (CRISPR group, n=200; and Buffer group, n=200) or not (Control group, n=200). Microinjection of CRISPR group is performed into the cytoplasm with 5 ng/µl of sgRNA and 20 ng/µl of Cas9 mRNA diluted in injection buffer (10 mM Tris pH 7.5, 0.1 mM EDTA), while Buffer group is injected with the same procedure but with buffer alone. Lastly, injected and non-injected embryos are transferred to culture medium under mineral oil, in 5% CO2, 5% 02 and 90% N2 in humidified atmosphere at 39° C. Cleavage rate on Day 2 (cleaved zygotes per total oocytes) and development rate on Day 6 (morulae and blastocysts per total oocytes) are recorded for all experimental groups. After Day 6, DNA from 20 CRISPR group embryos are analyzed by Sanger sequencing to detect the mutation at the OTOF gene level.

To determine the in vivo efficiency of the system, 53 blastocysts produced by CRISPR/Cas9 zygote microinjection are transferred to 29 recipient females. Only early blastocysts, blastocysts and expanded blastocysts classified as excellent or good (i.e. Grade 1 as defined in Stringfellow et al. 2010, *Manual of the International Embryo Transfer Society*) are transferred on Day 6 after fertilization. Embryo transfer is performed by minimally invasive surgery assisted by laparoscopy to place the embryos into the cranial side of the ipsilateral uterine horn to the corpus luteum. Recipient ewes are previously synchronized to be on Day 6 of the estrous cycle using a standard protocol to control ovulation described previously, as described by Menchaca et al. 2004, *Reprod Fertil Dev.* 16(4):403-413.

Monitoring of Fetuses and Lambs

Pregnancy diagnosis and fetal development are performed on Day 30 and 105, respectively, by using B-mode ultrasonography equipped with a 5 and 3.5 MHz probe. Day 0 of the experiment is defined as the moment of embryo fertilization. Several parameters are measured to study the development of fetuses at Day 105 of gestation: thoracic diameter, biparietal diameter, occipitonasal length and heart rate. At delivery, length of gestation, gender, rectal temperature, heart and respiratory rates, body weight, thoracic perimeter, biparietal diameter, crown-rump and occipitonasal length, height at withers, height at hips, width at hips and width at chest were recorded. Body weight and morphometric variables are determined at birth, and 15, 30 and 60 days later.

Identification and Genotyping of Transgenic Animals

Samples from skin and limb muscle of the lambs are taken seven days after birth and T7EI assay, western blot test and histology examinations are performed in order to identify and characterize KO founders and off-target sites. Total DNA is isolated from skin biopsies for all animals and from muscle for some animals. Samples are analyzed using capillary electrophoresis. Genotyping of OTOF exon 1 is performed by direct sequencing of PCR amplicons and in muscle biopsies by additional sequencing of isolated bacterial clones with individual amplicon sequences.

Analysis of Otoferlin Expression

Western blotting is performed to determine the presence of myostatin in the muscle fiber. Equal amounts of total proteins are run on 12% (v/v) gel electrophoresis and electrophoretically transferred to a PVDF membrane. Monoclonal mouse anti-otoferlin antibody is used in the western blotting. The washed membranes are incubated with 1:50000 dilution of secondary antibody linked to horseradish peroxidase (HPR). HPR activity is detected using western blot chemiluminescence.

AAV-OTOF Rescue Therapy in Transgenic Sheep Model

AAV-OTOF prepared in artificial perilymph is administered to OTOF knockout transgenic sheep to assess the ability to restore normal hearing function following delivery to the cochlea via trans-RWM infusion. Baseline auditory brainstem response (ABR) and distortion product optoacoustic emissions (DPOAEs) are measured in female sheep at 3 months of age (n=30), bilaterally, to assess pre-treatment inner hair cell (IHC) and outer hair cell (OHC) function. Following baseline ABR and DPOAE measurements, 20 uL of AAV1-OTOF at titers of 1.0e14, 3.2e13 and 1.0e13 vg/mL is injected into the left scala tympani of the sheep (n=10 per group). Each animal's right ear is left as an untreated control. ABR and DPOAE measurements are taken again bilaterally 1, 5 and 10 days following the surgical procedure. At 6 months post-procedure, additional bilateral ABR and DPOAE measurements are taken from all animals, and the animals are subsequently sacrificed and their *cochleae* removed.

In half of the sacrificed animals (n=5 from each of the dose cohorts), immunostaining is performed to identify hair cell structures and to assess OTOF protein expression along the cochlear sensory epithelium. Antibodies against markers for hair cells (Myo7a), supporting cells (Sox2) and otoferlin are used as described previously (Duncker et al. 2013, *J Neurosci* 33(22):9508-9519). At the basal, middle and apical turns of the organ of corti, total numbers of hair cells and those hair cells expressing OTOF are counted within 200 um regions.

In the remaining half of the sacrificed animals (remaining 5 animals from each dose cohort), cochlear tissue samples are collected from the same basal, middle and apical regions as described above, and assayed for otoferlin mRNA transcript as described previously (Duncker et al. 2013, *J Neurosci* 33(22):9508-9519, Heidrych et al. 2008, *Hum Mol Genet* 17:3814-3821, Heidrych et al., 2009, *Hum Mol Genet* 18:2779-2790).

Example 13: Human Clinical Example (Pediatric Treatment)

The subject is put under general anesthesia. The surgeon approaches the tympanic membrane from external auditory canal, makes a small incision at the inferior edge of the external auditory canal where it meets the tympani membrane, and lifts the tympanic membrane as a flap to expose the middle ear space. A surgical laser is used to make a small opening (approximately 2 mm) in the stapes footplate. The surgeon then penetrates the round window membrane with a microcatheter loaded with a solution of AAV-OTOF prepared in artificial perilymph at a titer of 1e13 vg/mL. The microcatheter is connected to a micromanipulator that infuses approximately 20 uL of the AAV-OTOF solution at a rate of approximately 1 uL/min. At the conclusion of the AAV-OTOF infusion, the surgeon withdraws the microcatheter and patches the holes in the stapes foot plate and RWM with a gel foam patch. The procedure concludes with replacement of the tympanic membrane flap.

Example 14: Non-Invasive Prenatal Testing of Maternal Blood to Detect OTOF Mutation Maternal blood samples (20-40 mL) are collected into Cell-free DNA tubes. At least 7 mL of plasma is isolated from each sample via a double centrifugation protocol of 2,000 g for 20 minutes, followed by 3,220 g for 30 minutes, with supernatant transfer following the first spin. cfDNA is isolated from 7-20 mL plasma using a QIAGEN QIAmp Circulating Nuclei Acid kit and eluted in 45 μL TE buffer. Pure maternal genomic DNA is isolated from the buffy coat obtained following the first centrifugation.

By combining thermodynamic modeling of the assays to select probes with minimized likelihood of probe-probe interaction with amplification approaches described previously (Stiller et al. 2009 *Genome Res* 19(10):1843-1848), multiplexing of 11,000 assays can be achieved. Maternal cfDNA and maternal genomic DNA samples are pre-amplified for 15 cycles using 11,000 target-specific assays and an aliquot is transferred to a second PCR reaction of 15 cycles using nested primers. Samples are prepared for sequencing by adding barcoded tags in a third 12-cycle round of PCR. The targets include SNPs corresponding to the 100 mutations in chromosome 2 known to lead to otoferlin loss-of-function (Zhang et al. 2016 *Clin Genetics* January 27). The amplicons are then sequenced using an Illumina HiSeq sequencer. Genome sequence alignment is performed using commercially available software.

Example 15: Alternative Examples (mRNA, Single Viral Vector, Non-Viral Vectors)

Single Viral Vector Preparation

Mouse otoferlin lacking the N-terminal domains can rescue the knockdown phenotype in otoferlin knockout zebrafish (Chatterjee et al. *Mol Cell Biol* 2015, 35(6):1043-1054). However, in mammals, missense mutations in the C2B and C2C domains have been linked to hearing loss (Longo-Guess et al., 2007 *Hear Res,* 234:21-28; Mirghomizadeh et al., 2002 *Neurobiol Dis* 10:157-164), suggesting that these domains are essential to the normal hearing-related function of otoferlin in higher species. The C2A domain of mammalian otoferlin does not bind $Ca^{2+}$, whereas all other C2 domains bind $Ca^{2+}$ with moderate (20-50 µM) or low (400-700 µM) affinity in the absence of acidic lipids. The C2D and C2E domains bind $Ca^{2+}$ as well as phosphatidylserine (PS) in a $Ca^{2+}$-dependent manner. A cDNA is produced that encodes a truncated form of otoferlin lacking the C2A, C2D and C2E domains. This cDNA is suitable for packaging in an AAV vector.

The truncated otoferlin construct (OTOFΔC2ADE) is derived and cloned from an original wildtype otoferlin plasmid encoding the full OTOF gene, as described by Padmanarayana et al. 2014 *Biochem* 53:5023-5033. Deletion of the coding region of the C2 domains is performed by PCR mutagenesis using domain-spanning oligonucleotides and a QuikChange site-directed mutagenesis kit applying the double mutagenic primer approach. Briefly, the PCR is performed as follows: 95° C. for 3 minutes; 18 cycles at 95° C. for 15 seconds, 65° C. for 1 minute, and 68° C. for 12 minutes; and 68° C. for 7 minutes. The PCR product is digested with DpnI, cloned into the DSC-B vector, and transformed into DH5alpha or XL10-Gold bacterial cells. Plasmid DNA is isolated by mini preparations and subsequently sequenced.

A plasmid containing a CBA promoter, a chimeric intron (β-globin), a consensus Kozak sequence, the OTOFΔC2ADE cDNA and a polyadenylation signal sequence is used for the AAV construct. Recombinant AAV is generated by transfection with an adenovirus-free method as used by Xiao et al. *J Virol* 1999, 73(5):3994-4003. The cis plasmids with AAV ITRs, the trans plasmid with AAV Rep and Cap genes, and a helper plasmid with an essential region from an adenovirus genome are co-transfected in 293 cells in a ratio of 1:1:2. AAV serotypes 1, 2, 3, 4, 5, 6, 7, 8, 9, rh8, rh10, rh39, rh43, and Anc80 are each prepared to encapsulate the OTOFΔC2ADE cDNA construct.

CELiD Preparation

The otoferlin gene is prepare for non-viral gene transfer as described by Li et al. 2013, *PLoS ONE* 8(8):e69879. First, *Spodoptera frugiperda* Sf9 cells are grown in suspension in serum-free media. The blasticidin-S deaminase (bs) gene is PCR-amplified from pIB/V5-His/CAT using the following primer pair:

(SEQ ID NO: 36)
5'-ATAAGCTTACGCTCAGTGGAACGAAAAC-3'
and (SEQ ID NO: 37)
5'-ATAAGCTTGACGTGTCAGTGTCAGTCCTGCTCCT-3'.

The 865 bp PCR product is digested with HindIII and ligated into HindIII-digested pFBGR. Sf9 cells are transfected with pFBGR-bsd using Cellfectin Transfection Reagent. At three days post-transfection, antibiotic-resistant cells are selected by the addition of blasticidin-S HCl (50 µg/mL) to the growth medium. After two weeks in selective medium, blasticidin-resistant ($bsd^r$) clones are derived by single-cell dilution or direct colony transfer techniques. The $bsd^r$ clones are expanded in insect cell culture medium supplemented with 10% FBS and blasticidin-S HCl (10 µg/mL) for 2 to 3 additional passages, then returned to serum-free medium with 10 µg/mL blasticidin-S HCl. After an additional 12 passages, blasticidin-S HCl is omitted from the medium and the cell lines are expanded for analysis. For functional screening, clonal Sf9/ITR-OTOF cell lines are infection (MOI=5) with a recombinant baculovirus, Bac-Rep, expressing the AAV type 2 Rep78 and Rep52 proteins and analyzed for induced OTOF expression. Clonal Sf9/ITR-OTOF cells with the highest levels of OTOF expression are expanded for CELiD-OTOF DNA preparation.

Clonal Sf9/ITR-OTOF cells are seeded at 2e6 cells/mL and infected with Bac-Rep (MOI=1 to 3). Cell viability and diameter are monitored daily until the cell diameter increased to 18-20 µm (uninfected cell diameter 14-15 µm), indicating that the cells are in the late stages of the viral infection. Extrachromosomal DNA is extracted from the Bac-Rep-infected, Sf9/ITR-GFP cells using a commercially available plasmid isolation kit. CELiD production is monitored by agarose gel electrophoresis and ethidium bromide staining of extrachromosomal DNA. CELiD DNA is produced in parental Sf9 cells by co-infection with two separate baculovirus expression vectors (BEV): Bac-Rep and a second BEV bearing an ITR-flanked transgene, such as Bac-OTOF. Infected Sf9 cells are harvested once the mean cell diameter increases by 4-5 µm and the percent viability decreases to 80-90%. CELiD DNA is isolated using a commercially available plasmid purification kit.

Clonal Sf9/ITR-OTOF cells are inoculated with various amounts of Bac-Rep stock. Cells are periodically harvested and extrachromosomal DNA is recovered using a commercially available DNA isolation kit. Extracted DNA is examined by either agarose gel electrophoresis or by PCR with OTOF-specific primer pairs for quantitative determination of CELiD DNA amounts. For western blotting, cell proteins are fractionated by SDS-polyacrylamide gel electrophoresis and transferred to nitrocellulose membranes. The membranes are incubated in blocking buffer (BB) composed of 5% non-fat dry milk (w:v) in phosphate-buffered saline plus 0.05% Tween-20 (PBST) for 1 hr at ambient temperature with orbital agitation. After washing the membranes in wash buffer (WB) composed of 3% non-fat dry milk in PBST, membranes are incubated with the appropriate primary antibody solution (diluted in BB) either at ambient temperature (1 hr) or 4° C. (overnight) with continuous orbital agitation. The following primary antibodies and dilution ratios are used: anti-AAV Rep mouse monoclonal antibody (mAb); 2. anti-baculovirus envelope glycoprotein gp64 mouse mAb; anti-OTOF mouse mAb. After incubation, primary antibody solutions are removed and membranes are washed in WB (3×5 mins). Non-conjugated mAbs are incubated with secondary antibody solution (goat, anti-mouse horseradish peroxidase (RP)-conjugate for 1 hr, and then washed with WB as above. HRP activity is detected by enhanced chemiluminescence (ECL).

Lipid Nanoparticles

Otoferlin cDNA or mRNA is encapsulated in poly(lactic-co-glycolic acid) nanoparticles by the double-emulsion solvent evaporation method described previously (O'Donnell and McGinity 1997 *Adv Drug Delivery Rev* 28(1):25-42), and in lipid nanoparticles (Pezzoli et al. 2013 *Methods MolBiol* 1025:269-279). Briefly, solid lipid nanoparticles can be generated from a microemulsion using Precirol ATO-5 and stearylamine as the cationic lipid. 500 mg of Precirol ATO-5 is heated to 10° C., above its melting point, and 10 mL of a hot aqueous solution of poloxamer and stearylamine in different proportions (1/1.25; 1/1.87; 1/3.12; 1/4.37 and 1/5) is added. The sample is stirred for 30 minutes at 14,000 rpm. The nanoparticles are generated by dispersing the hot microemulsion in cold water (2-5° C.) in an emulsion:water ratio of 1:5. To recover nanoparticles, the resultant suspension is centrifuged for three times at 3,000 rpm for 20 minutes at a temperature of 20° C., reconstituting the precipitate after centrifugation. Cationic solid lipid nanoparticles are lyophilized by being added an aqueous solution of cryoprotectant (5% mannitol) in a 1:2 (SLN:mannitol) ratio. The freezing temperature is set at −40° C. in the lyophilizer and samples are kept at this temperature for 2 hours. Lyophilization temperature is then set to 25° C. at a pressure of 0.2-0.4 mBa for 48 hours. A solution of the OTOF cDNA plasmid is prepared to a concentration of 2 μg/μL. A 25 μL aliquot of the plasmid DNA solution is then added to different volumes of the cationic SLN suspension to obtain ratios of between 15:1 and 1:1 (SLN:OTOF) by stirring.

Modified RNA

Polynucleotides, primary constructs mRNA (or modified mRNA, or "mmRNA") for use in accordance with the disclosure may be prepared according to any available technique including, but not limited to chemical synthesis, enzymatic synthesis, which is generally termed in vitro transcription (IVT), or enzymatic or chemical cleavage of a longer precursor, etc. Methods of synthesizing RNAs are known in the art (see, e.g., Gait, M. J. (ed.) Oligonucleotide synthesis: a practical approach, Oxford [Oxfordshire], Washington, D.C.: TRL Press, 1984; and Herdewijn, P. (ed.) Oligonucleotide synthesis: methods and applications, Methods in Molecular Biology, v. 288 (Clifton, N.J.) Totowa, N.J.: Humana Press, 2005; both of which are incorporated herein by reference).

The process of design and synthesis of the primary constructs of the disclosure generally includes the steps of gene construction, mRNA production (either with or without modifications) and purification. In the enzymatic synthesis method, a target polynucleotide sequence encoding the polypeptide of interest is first selected for incorporation into a vector, which will be amplified to produce a cDNA template. Optionally, the target polynucleotide sequence and/or any flanking sequences may be codon optimized. The cDNA template is then used to produce mRNA through in vitro transcription (IVT). After production, the mRNA may undergo purification and clean-up processes. The steps of which are provided in more detail below.

Gene Construction

The step of gene construction may include, but is not limited to gene synthesis, vector amplification, plasmid purification, plasmid linearization and clean-up, and cDNA template synthesis and clean-up.

Gene Synthesis

Once a polypeptide of interest, or target, is selected for production, a primary construct is designed. Within the primary construct, a first region of linked nucleosides encoding the polypeptide of interest may be constructed using an open reading frame (ORF) of a selected nucleic acid (DNA or RNA) transcript. The ORF may comprise the wild type ORF, an isoform, variant or a fragment thereof. As used herein, an "open reading frame" or "ORF" is meant to refer to a nucleic acid sequence (DNA or RNA) that encodes a polypeptide of interest. ORFs often begin with the start codon, ATG, and end with a nonsense or termination codon or signal. Further, the nucleotide sequence of the first region may be codon optimized. Codon optimization methods are known in the art and may be useful in efforts to achieve one or more of several goals. These goals include to match codon frequencies in target and host organisms to ensure proper folding, bias GC content to increase mRNA stability or reduce secondary structures, minimize tandem repeat codons or base runs that may impair gene construction or expression, customize transcriptional and translational control regions, insert or remove protein trafficking sequences, remove/add post translation modification sites in encoded protein (e.g. glycosylation sites), add, remove or shuffle protein domains, insert or delete restriction sites, modify ribosome binding sites and mRNA degradation sites, adjust translational rates to allow the various domains of the protein to fold properly, or reduce or eliminate problematic secondary structures within the mRNA. Codon optimization tools, algorithms and services are known in the art. Non-limiting examples include services from GeneArt (Life Technologies) and DNA2.0 (Menlo Park Calif.) and/or proprietary methods. In one embodiment, the ORF sequence is optimized using optimization algorithms. Codon options for each amino acid are known in the art.

Stop Codons

In one embodiment, the primary constructs of the present disclosure may include at least two stop codons before the 3' untranslated region (UTR). The stop codon may be selected from TGA, TAA and TAG. In one embodiment, the primary constructs of the present disclosure include the stop codon TGA and one additional stop codon. In a further embodiment, the additional stop codon may be TAA. In another embodiment, the primary constructs of the present disclosure include three stop codons.

Vector Amplification

The vector containing the primary construct is then amplified and the plasmid isolated and purified using methods known in the art such as, but not limited to, a maxi prep using the Invitrogen PURELINK™ HiPure Maxiprep Kit (Carlsbad, Calif.).

Plasmid Linearization

The plasmid may then be linearized using methods known in the art such as, but not limited to, the use of restriction enzymes and buffers. The linearization reaction may be purified using methods including, for example Invitrogen's PURELINK® PCR Micro Kit (Carlsbad, Calif.), and HPLC based purification methods such as, but not limited to, strong anion exchange HPLC, weak anion exchange HPLC, reverse phase HPLC (RP-HPLC), and hydrophobic interaction HPLC (HIC-HPLC) and Invitrogen's standard PURELINK™ PCR Kit (Carlsbad, Calif.). The purification method may be modified depending on the size of the linearization reaction conducted. The linearized plasmid is then used to generate cDNA for in vitro transcription (IVT) reactions.

cDNA Template Synthesis

A cDNA template may be synthesized by having a linearized plasmid undergo polymerase chain reaction (PCR). Primer-probe design for any amplification is within the skill of those in the art. Probes may also contain chemically modified bases to increase base-pairing fidelity to the target molecule and base-pairing strength. Such modifications may include 5-methyl-Cytidine, 2,6-di-amino-purine, 2'-fluoro, phosphoro-thioate, or locked nucleic acids.

mRNA Production

The process of mRNA or mmRNA production may include, but is not limited to, in vitro transcription, cDNA template removal and RNA clean-up, and mRNA capping and/or tailing reactions.

In Vitro Transcription

The cDNA produced above may be transcribed using an in vitro transcription (IVT) system. The system typically comprises a transcription buffer, nucleotide triphosphates (NTPs), an RNase inhibitor and a polymerase. The NTPs may be manufactured in house, may be selected from a supplier, or may be synthesized as described herein. The NTPs may be selected from, but are not limited to, those described herein including natural and unnatural (modified) NTPs. The polymerase may be selected from, but is not limited to, T7 RNA polymerase, T3 RNA polymerase and mutant polymerases such as, but not limited to, polymerases able to incorporate modified nucleic acids.

5' Capping

The 5' cap structure of an mRNA is involved in nuclear export, increasing mRNA stability. It binds the mRNA Cap Binding Protein (CBP), which is responsible for mRNA stability in the cell and translation competency through the association of CBP with poly(A) binding protein to form the mature cyclic mRNA species. The cap further assists the removal of 5' proximal introns during mRNA splicing. Endogenous mRNA molecules may be 5'-end capped generating a 5'-ppp-5'-triphosphate linkage between a terminal guanosine cap residue and the 5'-terminal transcribed sense nucleotide of the mRNA molecule. This 5'-guanylate cap may then be methylated to generate an N7-methyl-guanylate residue. The ribose sugars of the terminal and/or anteterminal transcribed nucleotides of the 5' end of the mRNA may optionally also be 2'-O-methylated. 5'-decapping through hydrolysis and cleavage of the guanylate cap structure may target a nucleic acid molecule, such as an mRNA molecule, for degradation. Modifications to the polynucleotides, primary constructs, and mmRNA of the present disclosure may generate a non-hydrolyzable cap structure preventing decapping and thus increasing mRNA half-life. Because cap structure hydrolysis requires cleavage of 5'-ppp-5' phosphorodiester linkages, modified nucleotides may be used during the capping reaction. For example, a Vaccinia Capping Enzyme from New England Biolabs (Ipswich, Mass.) may be used with .alpha.-thio-guanosine nucleotides according to the manufacturer's instructions to create a phosphorothioate linkage in the 5'-ppp-5' cap. Additional modified guanosine nucleotides may be used such as .alpha.-methyl-phosphonate and seleno-phosphate nucleotides. Additional modifications include, but are not limited to, 2'-O-methylation of the ribose sugars of 5'-terminal and/or 5'-anteterminal nucleotides of the mRNA (as mentioned above) on the 2'-hydroxyl group of the sugar ring. Multiple distinct 5'-cap structures can be used to generate the 5'-cap of a nucleic acid molecule, such as an mRNA molecule.

Flanking Regions Untranslated Regions (UTRs)

Untranslated regions (UTRs) of a gene are transcribed but not translated. The 5'UTR starts at the transcription start site and continues to the start codon but does not include the start codon, whereas the 3'UTR starts immediately following the stop codon and continues until the transcriptional termination signal. UTRs can be incorporated into the polynucleotides, primary constructs and/or mRNA of the present disclosure to enhance the stability of the molecule. UTRs also be incorporated to ensure controlled down-regulation of the transcript in case they are misdirected to undesired organs sites.

5' UTR and Translation Initiation

By engineering the features typically found in abundantly expressed genes of specific target organs, one can enhance the stability and protein production of the polynucleotides, primary constructs or mmRNA of the disclosure. For example, introns or portions of introns sequences may be incorporated into the flanking regions of the polynucleotides, primary constructs or mmRNA of the disclosure.

AU Rich Elements

AU rich elements (AREs) can be separated into three classes (Chen et al., Mol. Cell. Biol. 15:5777-5788, 1995; Chen et al., Mol. Cell Biol. 15:2010-2018, 1995): Class I AREs contain several dispersed copies of an AUUUA motif within U-rich regions. C-Myc and MyoD contain class I AREs. Class II AREs possess two or more overlapping UUAUUUA(U/A)(U/A) (SEQ ID NO: 38)nonamers. Molecules containing this type of AREs include GM-CSF and TNF-a. Class III ARES are less well defined. These U rich regions do not contain an AUUUA motif c-Jun and Myogenin are two well-studied examples of this class. Most proteins binding to the AREs are known to destabilize the messenger, whereas members of the ELAV family, most notably HuR, have been documented to increase the stability of mRNA. HuR binds to AREs of all the three classes. Engineering the HuR specific binding sites into the 3' UTR of nucleic acid molecules will lead to HuR binding and thus, stabilization of the message in vivo. Introduction, removal or modification of 3' UTR AU rich elements (AREs) can be used to modulate the stability of polynucleotides, primary constructs or mmRNA of the disclosure. When engineering specific polynucleotides, primary constructs or mmRNA, one or more copies of an ARE can be introduced to make polynucleotides, primary constructs or mmRNA of the disclosure less stable and thereby curtail translation and decrease production of the resultant protein. Likewise, AREs can be identified and removed or mutated to increase the intracellular stability and thus increase translation and production of the resultant protein. Transfection experiments can be conducted in relevant cell lines, using polynucleotides, primary constructs or mmRNA of the disclosure and protein production can be assayed at various time points post-transfection. For example, cells can be transfected with different ARE-engineering molecules and by using an ELISA kit to the relevant protein and assaying protein produced at 6 hour, 12 hour, 24 hour, 48 hour, and 7 days post-transfection. The polynucleotide, primary construct, and mRNA of the disclosure can be formulated using natural and/or synthetic polymers. Non-limiting examples of polymers which may be used for delivery include, but are not limited to, DYNAMIC POLYCONJUGATE® (Arrowhead Research Corp., Pasadena, Calif.) formulations from MIRUS® Bio (Madison, Wis.) and Roche Madison (Madison, Wis.), PHASERX™ polymer formulations such as, without limitation, SMARTT POLYMER TECHNOLOGY™ (PHASERX®, Seattle, Wash.), DMRI/DOPE, poloxamer, VAXFECTIN® adjuvant from Vical (San Diego, Calif.), chitosan, cyclodextrin from Calando Pharmaceuticals (Pasadena, Calif.), dendrimers and poly(lactic-co-glycolic acid) (PLGA) polymers. RONDEL™ (RNAi/Oligonucleotide Nanoparticle Delivery) polymers (Arrowhead Research Corporation, Pasadena, Calif.) and pH responsive co-block polymers such as, but not limited to, PHASERX® (Seattle, Wash.). Many of these polymer approaches have demonstrated efficacy in delivering oligonucleotides in vivo into the cell cytoplasm (reviewed in deFougerolles Hum Gene Ther. 2008 19:125-132; herein incorporated by reference in its entirety). Two polymer approaches that have yielded robust in vivo delivery of nucleic acids, in this case with small interfering RNA (siRNA), are dynamic polyconjugates and cyclodextrin-based nanoparticles. The first of these delivery approaches uses dynamic polyconjugates and has been shown in vivo in mice to effectively deliver siRNA and silence endogenous target mRNA in hepatocytes (Rozema et al., Proc Natl Acad Sci USA. 2007 104:12982-12887; herein incorporated by reference in its entirety). This particular approach is a multicomponent polymer system whose key features include a membrane-active polymer to which nucleic acid, in this case siRNA, is covalently coupled via a disulfide bond and where both PEG (for charge masking) and N-acetylgalactosamine (for hepatocyte targeting) groups are linked via pH-sensitive bonds (Rozema et al., Proc Natl Acad Sci USA. 2007 104:12982-12887; herein incorporated by reference in its entirety). On binding to the hepatocyte and entry into the endosome, the polymer complex disassembles in the low-pH environment, with the polymer exposing its positive charge, leading to endosomal escape and cytoplasmic release of the siRNA from the polymer. Through replacement of the N-acetylgalactosamine group with a mannose group, it was shown one could alter targeting from asialoglycoprotein receptor-expressing hepatocytes to sinusoidal endothelium and Kupffer cells. Another polymer approach involves using transferrin-targeted cyclodextrin-containing polycation nanoparticles. These nanoparticles have demonstrated targeted silencing of the EWS-FLI1 gene product in transferrin receptor-expressing Ewing's sarcoma tumor cells (Hu-Lieskovan et al., Cancer Res. 2005 65: 8984-8982; herein incorporated by reference in its entirety) and siRNA formulated in these nanoparticles was well tolerated in non-human primates (Heidel et al., Proc Natl Acad Sci USA 2007 104:5715-21; herein incorporated by reference in its entirety). Both of these delivery strategies incorporate rational approaches using both targeted delivery and endosomal escape mechanisms.

Figure 1:
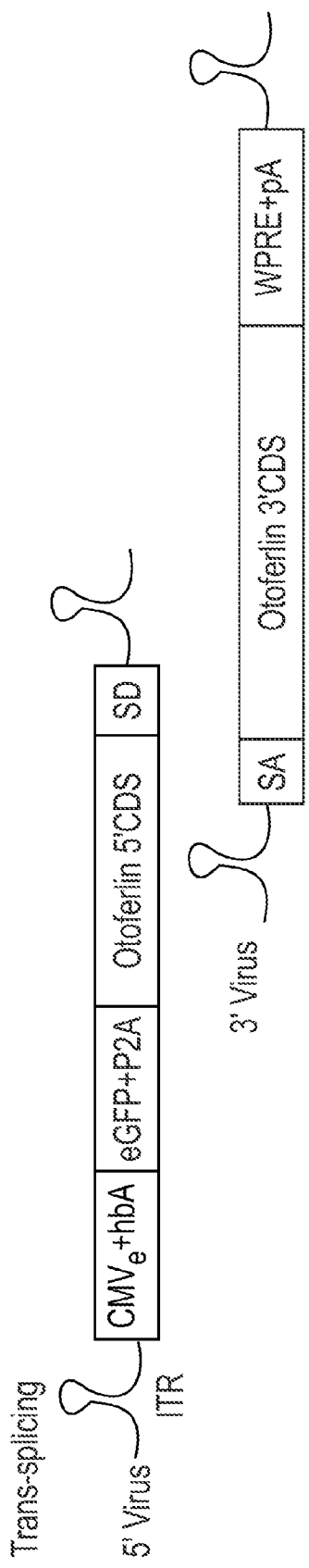
FIG. 1 is an exemplary schematic representation of a genetic map of the 5' and 3' vectors for dual-AAV transduction in inner hair cells (IHCs) using the trans-splicing approach. In the 5' vector, a CMV enhancer (CMVe) and a human β-actin promoter (hbA) drive the transcription of an mRNA coding for eGFP and a P2A peptide, which is cleaved during translation. The 5' vector also contains cDNA encoding an N-terminal portion of otoferlin and a splice donor site (SD). The SD DNA sequence was provided by Trapani et al. (2014) *EMBO Mol Med* 6 194-211. In the 3' vector, a splice acceptor site (SA) was subcloned after the first inverted terminal repeat (ITR) and before the 3' part of the coding sequence of otoferlin. This is followed by mRNA stabilizing sequences, woodchuck hepatitis virus posttranscriptional regulatory element (WPRE), and the poly-adenylation signal (pA).

Example 16: Restoration of Hearing in Otof$^{-/-}$ Mice by the Trans-Splicing Approach An experiment was performed to determine whether hearing could be restored in Otof$^{-/-}$ mice using a combination of two different vectors using the methods described herein.
Materials and Methods
Cloning Mouse otoferlin cDNA transcript variant 4 (KX060996; coding DNA sequence (CDS) identical to reference sequence NM_001313767) that had been subcloned from cochlear cDNA (Strenzke et al. (2016) EMBO J. 35 2519-2535) was subcloned into the backbone for AAV production using standard cloning strategies including restriction digests and ligation. Both vectors contain ITRs of serotype 2. A CMV enhancer and human J-actin promoter were subcloned into the 5' vector, which contains eGFP cDNA and a P2A signal (FIG. 1). The otoferlin CDS was split at the exon21-exon22 junction into two halves of about similar size. The 5' vector encodes the N-terminal part of otoferlin from amino acid 1 to 844, the 3' vector contains the coding sequence for amino acids 845 to 1977 and woodchuck hepatitis virus posttranscriptional regulatory element (WPRE) and poly-adenlyation signals.

For the trans-splicing approach, a splice donor site (Trapani et al. (2014) *EMBO Mol. Med.* 6(2):194-211, 2014) follows the coding sequence in the 5' vector. In the 3' vector, a splice acceptor site was subcloned just before the coding sequence for otoferlin. Within the coding sequence, a silent mutation was introduced, generating an additional site for restriction digestion.

Figure 2:
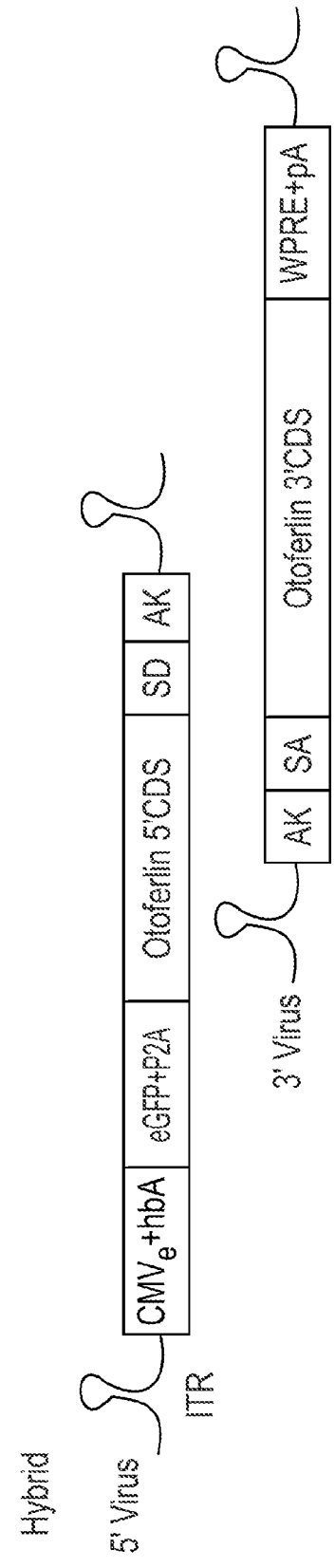
FIG. 2 is an exemplary schematic representation of a genetic map of the 5' and 3' vectors for dual-AAV transduction in IHCs, using the hybrid approach. In addition to the elements described in FIG. 1, highly recombinogenic sequences from F1 phage (AK) sequences were included at the 3' end of the'5 vector and at the 5' end of the 3' vector to force correct vector assembly (Trapani et al. (2014) EMBO Mol Med 6 194-211).

For the hybrid approach, an F1 phage recombinogenic region for homologous recombination was subcloned right after the splice donor site in the 5' vector and before the splice acceptor site of the 3' vector (FIG. 2). The plasmid identities were verified by Sanger sequencing.
Virus Production and Purification Dual AAV vectors were produced by transient transfection of HEK293 cells grown in multi-level cell factories. The cells were co-transduced with helper plasmids for virus production encoding serotype 6 capsid proteins. Purification of cell lysates was performed by iodixanol density-gradient ultracentrifugation, followed by a second purification and concentration step by FPLC affinity-chromatography (Asai et al. (2015) Nat. Neurosci. 18 1584-1593; Tereshchenko et al. (2014) Neurobiol. Dis. 65 35-42). For the trans-splicing approach, the 5' vector achieved a concentration of ~2.8×10$^8$ transducing units/µL. The 3' vector reached ~1.4×10$^8$ transducing units/µL. For the hybrid approach, both viruses were purified simultaneously in the same solutions, reaching slightly higher virus titers.
Mouse Strains Otoferlin knock-out (Otof$^{-/-}$) mice were generated as described (Reisinger et al. (2011) J. Neurosci. 31 4886-4895) and backcrossed for at least 5 generations to either C57/B16N or to CD1 strains. For virus injection, F1 offspring from Otof$^{-/-}$ CD1 females and Otof$^{-/-}$ C57/B16N males were used. For wild type controls, Otof$^{-/-}$ mice from Otof$^{+/-}$ C57/B16N breeding were crossed with CD1 wild type mice (Charles River).
Virus Injection Mice at postnatal day 6 to 7 (P6-7) were anesthetized using 2.5%-5% isoflurane. The skin behind the left bulla was opened and the round window niche was exposed. Virus solution in a glass capillary was injected through the round window membrane using a PLI-100A BASIC PICOLITER microinjector (Harvard Apparatus GmbH, Germany) as pressure source, thereby injecting about 0.2-0.5 µL solution per inner ear (Jung et al. (2015) EMBO J. 34 2686-2702). The skin was closed and the pups were raised by their mothers.
Immunohistochemistry Immunostaining was performed as previously described (Strenzke et al. (2016) EMBO J. 35 2519-2535). Temporal bones were isolated after decapitation and a part of the cochlear bony shelf was opened and the round window was perforated. The temporal bones were fixed in 4% formaldehyde in PBS for 45 min at 4° C. Cochleas of mice older than P20 were decalcified either for 5 min in Morse's solution or 2 days in 0.12M EDTA solution. Blocking was performed with 17% normal goat serum, 0.3% Triton X-100, 0.45 mM NaCl, and 20 mM phosphate buffer, pH 7.4. Antibodies were diluted in blocking solution and applied to the organ of Corti situated in the temporal bones before apical and basal turns were excised. The following antibodies were used: goat IgG1 anti-Ctbp2 mouse anti-otoferlin (RRID:AB_881807, Abcam, Cambridge, UK, 1:300), rabbit anti-otoferlin (Synaptic Systems, Gottingen, Germany, 1:100), goat anti-calbindin D28k and secondary Alexa Fluor®405, Alexa Fluor®488-, Alexa Fluor®568-, Alexa Fluor®594-, and AlexaFluor647-labeled antibodies (Invitrogen, 1:200). Confocal microscopy images were acquired as stacks of 2D images with a step size of 0.6 µm using a laser scanning confocal microscope (Leica TCS SP5, Leica Microsystems CMS GmbH, Mannheim, Germany) with a 63×glycerol immersion objective (NA=1.456). The number of synapses in 14-16 day old inner hair cells (IHCs) were counted using the cell counter plugin in ImageJ software as number of Ctbp2 spots. Image analysis to determine fractional levels of membrane bound otoferlin is described in Strenzke et al. (2016a) EMBO J. 35 2519-2535).

Electrophysiology $Ca^{2+}$ currents and plasma membrane capacitance from IHCs were measured by patch-clamp of IHCs from the apical coils of freshly dissected organs of Corti in the perforated-patch configuration at room temperature (20-25° C.) as described (Moser & Beutner (2000) Proc Natl Acad Sci USA 97 883-888). The pipette solution contained 130 mM Cs-gluconate, 10 mM tetraethylammonium-chloride (TEA-Cl), 10 mM 4-aminopyridine (Merck, Darmstadt, Germany), 1 mM $MgCl_2$, 10 mM Cs-HEPES (pH 7.17, osmolarity approx. 290 mOsm), 300 µg/mL amphotericin B (Calbiochem, La Jolla, Calif.). The extracellular solution contained 110 mM NaCl, 35 mM TEA-Cl, 2.8 mM KCl, 2 mM $CaCl_2$), 1 mM $MgCl_2$, 10 mM Na-HEPES, 1 mM CsCl, 11.1 mM D-glucose (pH 7.2, osmolarity approx. 300 mOsm). Unless stated otherwise, all chemicals were obtained from Sigma-Aldrich (Taufkirchen, Germany). An EPC-9 amplifier (HEKA Electronics, Lambrecht, Germany) controlled by Pulse software was used to sample and filter currents at 20 kHz and at 5 kHz, respectively. Potentials were corrected for liquid junction potentials (−14 mV). ΔCm was measured using depolarizations of different durations to peak $Ca^{2+}$ current potential, with 30-60 sec inter-stimulus intervals, as previously described (Beutner & Moser (2000) Proc Natl Acad Sci USA 97 883-888). All currents were leak-corrected using a P/6-protocol. The vesicle replenishment rate was calculated as ΔCm during 100 ms depolarization minus ΔCm at 20 ms depolarization, divided by 45 aF per vesicle (Neef et al. (2007) The Journal of Neuroscience 27 12933-12944) to get the number of vesicles. The number of active zones per cell was determined with immunohistochemistry (10 synapses for transduced $Otof^{-/-}$ IHCs, 14 synapses for $Otof^{+/+}$ IHCs).

ABR Recordings

Auditory brainstem responses were recorded as described (Jing et al. (2013) J Neurosci 33 4456-4467).

RNA Isolation, Reverse Transcription, PCR and Sequencing

Total RNA was isolated from acutely dissected organs of Corti with Invitrogen™ TRIzol™ Plus RNA Purification Kit (Thermo Fisher Scientific, 12183555) according to the manufacturer's instructions and used as a template for cDNA synthesis using SuperScript® IV First-Strand Synthesis System (ThermoFisher Scientific, 18091050) with Oligo(dT)$_{20}$ and Random Hexamer primers. The cDNA was further used in PCR amplification reactions using DreamTaq® Polymerase (Thermo Fisher Scientific, EP0702), using the following primers:

N-terminal fragment
(SEQ ID NO: 24)
3'-CCCACAAGGCCAACGAGACGGATGAGGAC-5'
and (SEQ ID NO: 25)
3'- AAGAGGCTTCGGGCCTGATACATGTGTGCT-5';

Assembly fragment
(SEQ ID NO: 26)
3'-ACGGCAATGAAGTCGATGGTATGTCCCGGC-5';

C-terminal fragment
(SEQ ID NO: 27)
3'-CTGACCTGCCACCCATCAATGGCCCAGTGG-5'
and (SEQ ID NO: 28)
3'-CTATGCGCTCCTCCTCTGTGGAGCCATCCT-5'.

All bands were excised, cloned into a pCR2.1™-TOPO® vector using the TOPO® TA® Cloning Kit (Thermo Fisher Scientific, 450641), and shot into One Shot™ TOP10 Electrocomp™ E. coli cells (Thermo Fisher Scientific, C404050). All clones were screened for the correct insert and verified by Sanger sequencing.

Results

To test the trans-splicing approach, dual-AAV vectors were generated, each comprising one half of the otoferlin CDS. In the first vector, a human ß-actin promoter and a CMV enhancer were used to drive the expression of eGFP and the 5' otoferlin fragment, separated by a P2A sequence (FIG. 1). The second vector contained the 3' otoferlin CDS and mRNA stabilizing elements. AAV vectors underwent head-to-tail multimerization in the nuclei of target cells by non-homologous end joining of the inverted terminal repeats (ITRs), thereby promoting the assembly of the two vector genomes. A splice donor site in the 5' vector and a splice acceptor site in the 3' vector were included to force the processing of a correct full-length otoferlin mRNA (FIG. 1).

Figure 3:
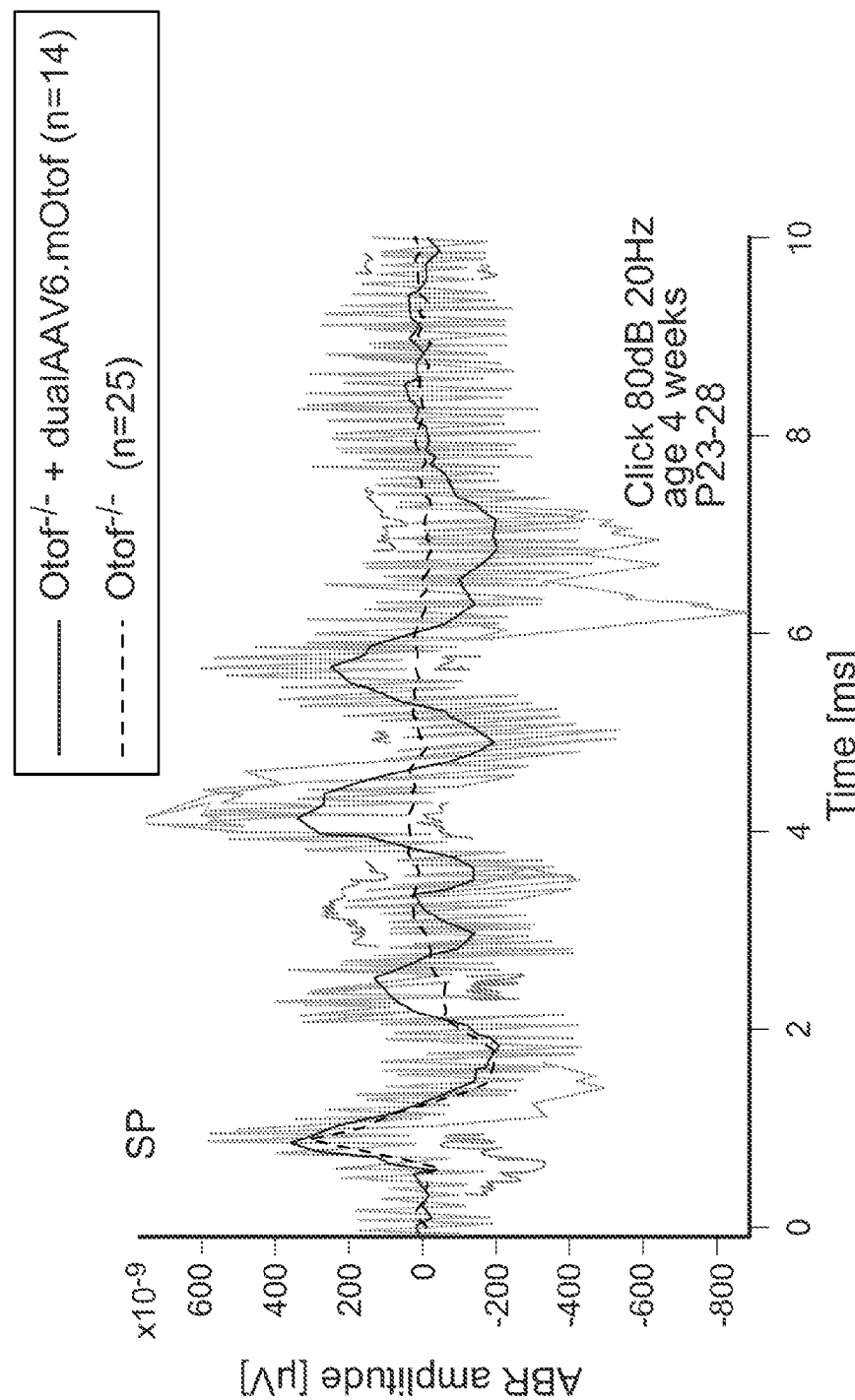
FIG. 3 is a graph showing auditory brainstem responses (ABR) amplitude over time in non-transduced $Otof^{-/-}$ mice (n=25; thin black line) and $Otof^{-/-}$ mice after dual-AAV mediated expression of otoferlin (n=14; grey lines represent individual animals, thick black line is the average response across all animals).

Otoferlin knock-out $Otof^{-/-}$ animals on postnatal day 6-7 (P6-7) were co-injected with both AAVs (~1.4-2.8×10$^8$ transducing units/µL) through the round window membrane of the left ear (FIG. 3). Non-injected $Otof^{-/-}$ littermates and wild-type animals, some of which were injected with eGFP-encoding AAVs, served as controls. At P23-28, hearing was tested using auditory brainstem recordings (ABRs), and the inner hair cell (IHC) transduction rate and otoferlin expression levels were tested using immunohistochemistry. As shown in FIG. 3, in non-transduced $Otof^{-/-}$ mice, ABR recordings elicited a prominent summating potential (SP) due to the depolarization of IHCs, but these signals were not transmitted to the brainstem, resulting in a flat line. After dual-AAV transduction, mice displayed typical ABR waves, indicating that auditory information was processed to the brain stem.

Figure 4:
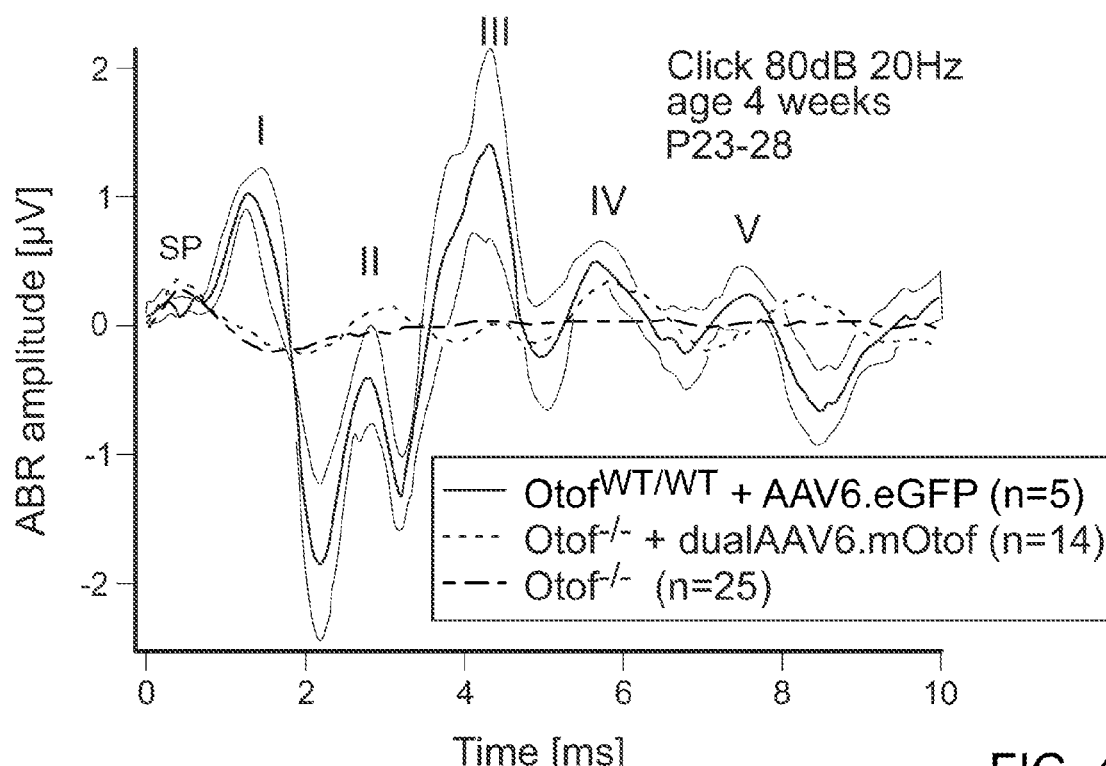
FIG. 4 is a graph showing ABR amplitude over time in non-transduced $Otof^{-/-}$ mice (n=25; long dashed line), $Otof^{-/-}$ mice after dual-AAV mediated expression of otoferlin (n=14; short dashed line) and wild type $Otof^{wt/wt}$ mice after dual-AAV with enhanced green fluorescent protein (eGFP) transduction (n=5; thin black lines represent individual animals, thick black line is the average amplitude across all animals).
Figure 5:
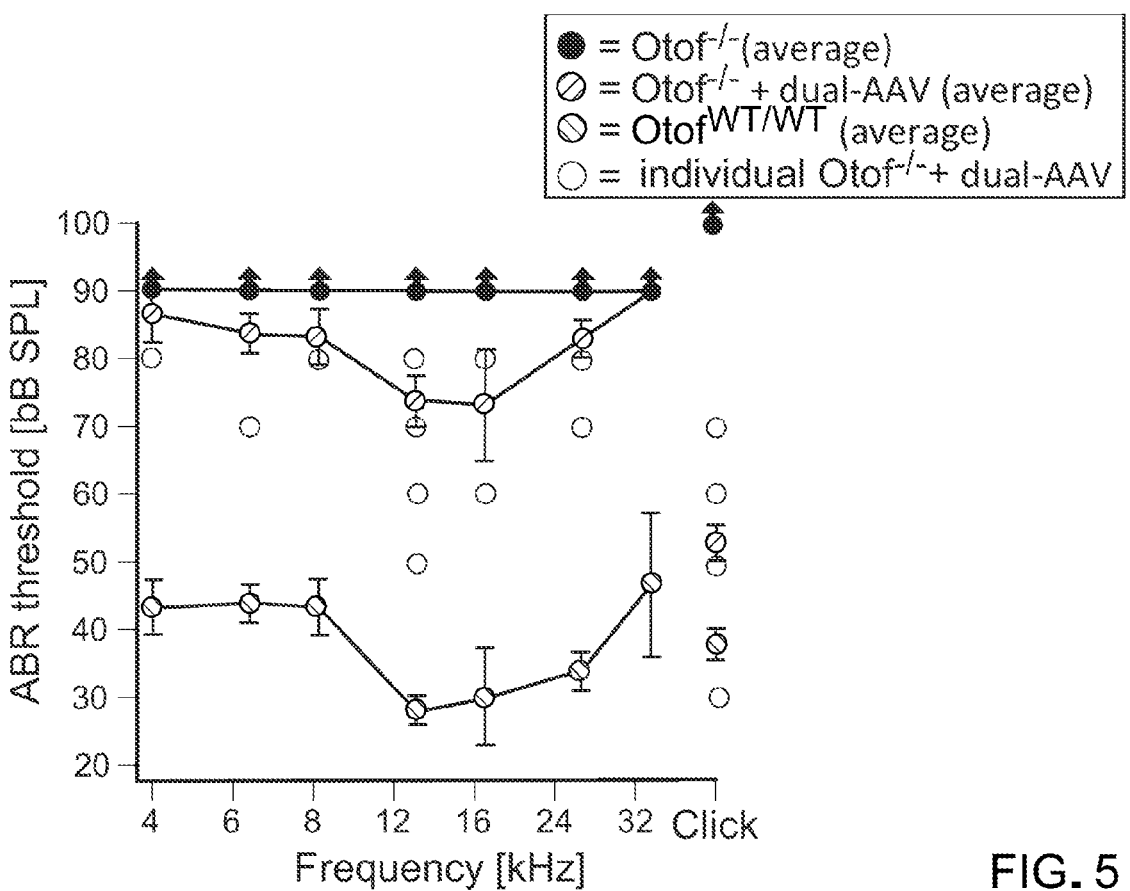
FIG. 5 is an exemplary graph showing ABR threshold (in dB SPL) over frequency (in kHz) in response to pure tones or click stimuli. The minimal sound pressure level (SPL) at which waves can be detected is displayed for individual $Otof^{-/-}$ animals with dual-AAV mediated expression of otoferlin (white circles represent individual animals, circle with diagonal line fill is the average threshold across all animals), for non-transduced $Otof^{-/-}$ animals (black circles), and for $Otof^{wt/wt}$ animals after dual-AAV with eGFP transduction (circle with checkered fill), in response to pure tones or click stimuli.

In response to click stimuli, thresholds in successfully transduced ears were at 54±3 dB (range: 30-70 dB). In control experiments, non-transduced $Otof^{-/-}$ littermate animals showed no ABR waves except the summating potential, even at 100 dB sound stimulus. Pure tone stimuli elicited ABR responses in most transduced ears, but not in non-transduced $Otof^{-/-}$ littermate controls (FIGS. 3-6). Pure tone ABRs were detectable for low (6 kHz), mid (12 kHz), and high frequencies (24 kHz). The $Otof^{+/+}$ controls showed normal ABR wave forms with a threshold of 39±1 dB (range: 30-40 dB) (FIGS. 4 and 5). As shown in FIG. 4, the amplitudes of ABR waves in transduced $Otof^{-/-}$ mice are smaller than in wild type $Otof^{wt/wt}$ mice transduced with dual-AAV with enhanced green fluorescent protein (eGFP).

To test for correct concatemerization and reassembly of the full-length otoferlin mRNA in the right orientation, mRNA was extracted from transduced and non-transduced P14 Otof$^{-/-}$ organs of Corti. After reverse transcription into cDNA, three fragments from otoferlin mRNA were amplified: one encoded by the 5' virus, one encoded by the 3' virus, and one fragment covering the site of assembly of the two vectors. Sanger sequencing of the PCR amplicons revealed the correct otoferlin transcripts containing the silent mutation of virally transduced otoferlin, indicating correct assembly of dual-AAV transduced otoferlin mRNA.

Figure 6:
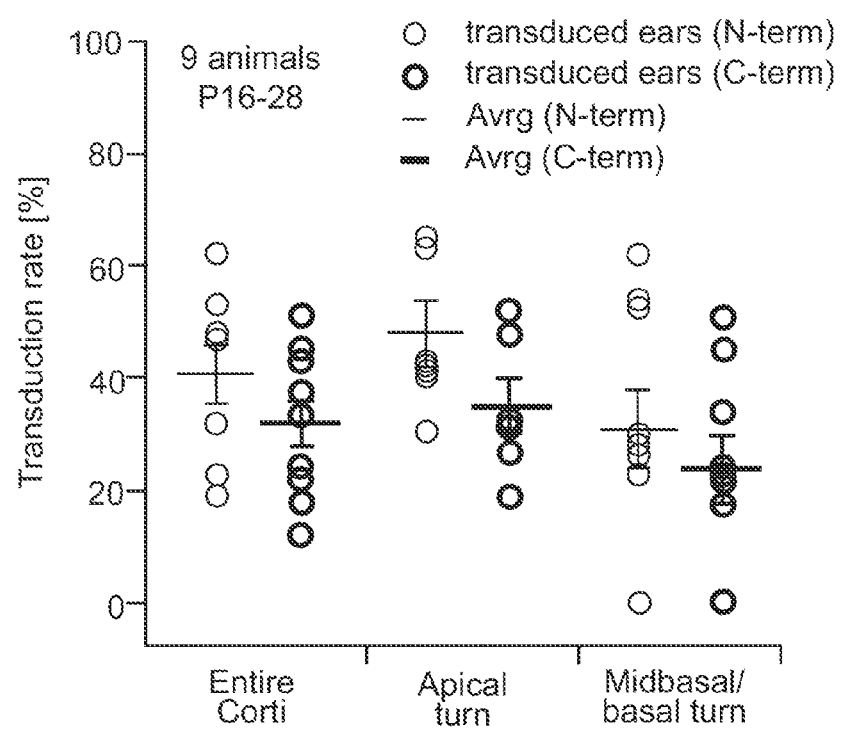
FIG. 6 is a graph showing the transduction rates of IHCs along the cochlea (e.g., entire Corti, apical turn, and mid-basal/basal turn), determined by immunohistochemistry using two different antibodies, one binding the N-terminal otoferlin fragment, and the other binding to the very C-terminal part of otoferlin.
Figure 7:
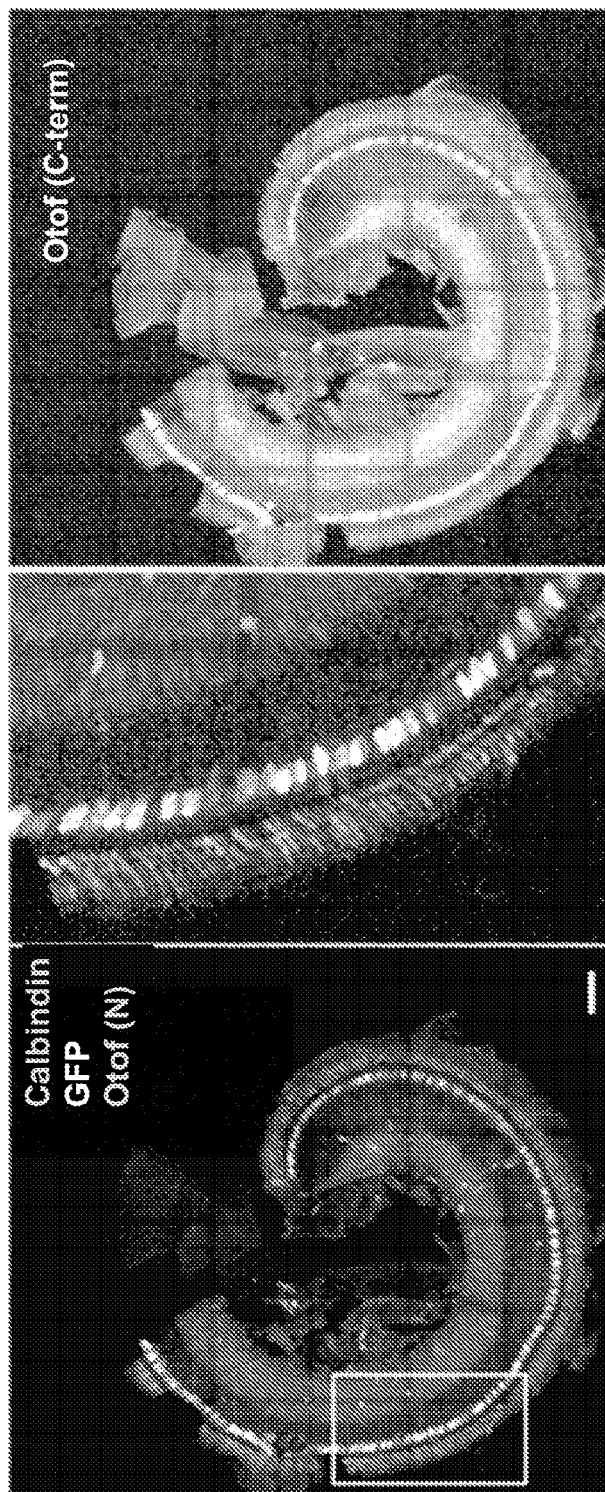
FIG. 7 is a set of immunohistochemical images of one organ of Corti from an $Otof^{-/-}$ mouse after dual-AAV mediated expression of otoferlin. Calbindin was used as marker for inner and outer hair cells. Cells expressing eGFP indicate virus transduction of at least the 5' virus. Left and middle panels show anti-otoferlin antibody staining (Abcam) in the N-terminal half of otoferlin. Right panel shows C-terminal anti-otoferlin antibody staining (Synaptic Systems). Together, all three panels demonstrate that full-length otoferlin is expressed in IHCs. Importantly, despite the AAVs transduce several cell types in the organ of Corti (indicated by eGFP fluorescence), otoferlin expression was restricted to inner hair cells. Scale bar: 100 μm.

To study the inner hair cell (IHC) transduction rate and otoferlin expression levels, organs of Corti were dissected at P18-28 and analyzed by immunohistochemistry using two anti-otoferlin antibodies, one binding to the N-terminal part and the other binding to the very C-terminal part of otoferlin (FIG. 6 and FIG. 7). As shown in FIG. 7, calbindin was used as marker for inner and outer hair cells. Cells expressing eGFP indicated virus transduction of at least the 5' virus. Anti-otoferlin antibody staining (Abcam) in the N-terminal half of otoferlin indicated expression of the N-terminal part of otoferlin. C-terminal anti-otoferlin antibody staining (Synaptic Systems) indicated expression of the C-terminal part of otoferlin. Taken together, all three panels in FIG. 7 demonstrated that full-length otoferlin was expressed in IHCs. Twelve to fifty-one percent (on average 32±4%, s.e.m.) of IHCs showed full-length otoferlin expression with higher IHC transduction rates in the apex of the cochlea (low frequency region, 35±5% transduction rate; range: 19-52%) than in the basal turn (24±6%, range: 0-51%). About 10% of all IHCs showed N-terminal otoferlin signal, but no C-terminal otoferlin expression, presumably indicating transduction of the 5' vector only. No signal was observed in the Otof$^{-/-}$ control littermates. Remarkably, both N-terminal and C-terminal otoferlin signal was found only in IHCs, whereas eGFP fluorescence could additionally be found in outer hair cells (OHCs) as well as in other cell types that did not express otoferlin in parallel. Thus, despite AAV transduced in several cell types in the organ of Corti, expression of otoferlin was restricted to IHCs. To quantify otoferlin expression levels, immunofluorescence using the N-terminal anti-otoferlin antibody in confocal stacks of immunostained IHCs was measured (as in Strenzke et al. (2016) EMBO J. 35 2519-2535). In dual-AAV transduced Otof$^{-/-}$ IHCs, otoferlin levels were found to be ~30% of wild-type controls.

Since synapses in Otof$^{-/-}$ mice are partially lost during the second postnatal week, an experiment was conducted to determine whether expression of otoferlin in these IHCs affected synapse numbers. Synaptic ribbons were immunolabelled; 9±0.3 synapses were found in 26 day old non-transduced Otof$^{-/-}$ IHCs (n=42 cells, N=3 animals). In dual-AAV transduced Otof$^{-/-}$, 10±0.2 synapses were identified by eGFP fluorescence (n=59 cells; N=3 animals). In contrast, wild-type IHCs displayed 13-16 synapses per IHC (Strenzke et al. (2016) EMBO J. 35 2519-2535). Thus, the expression of otoferlin after dual-AAV injection at P6 partially prevented the loss of synapses from P26 Otof$^{-/-}$ IHCs.

Figure 15:
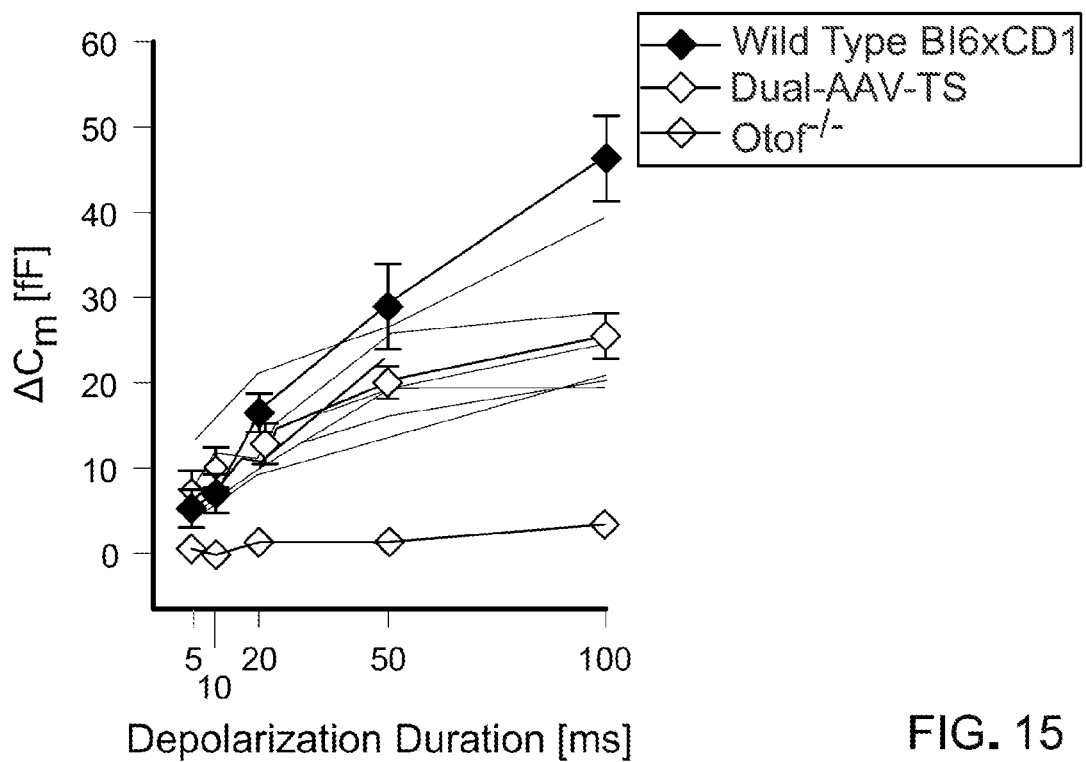
FIG. 15 is a graph showing plasma membrane capacitance (ΔCm) over the duration of depolarization in IHCs of Otof$^{-/-}$ mice transduced with the two vectors shown in FIG. 2 (medium shading; thick line), IHCs in wildtype mice (dark shading; medium thickness line), and IHCs in Otof$^{-/-}$ mice.
Figure 16:
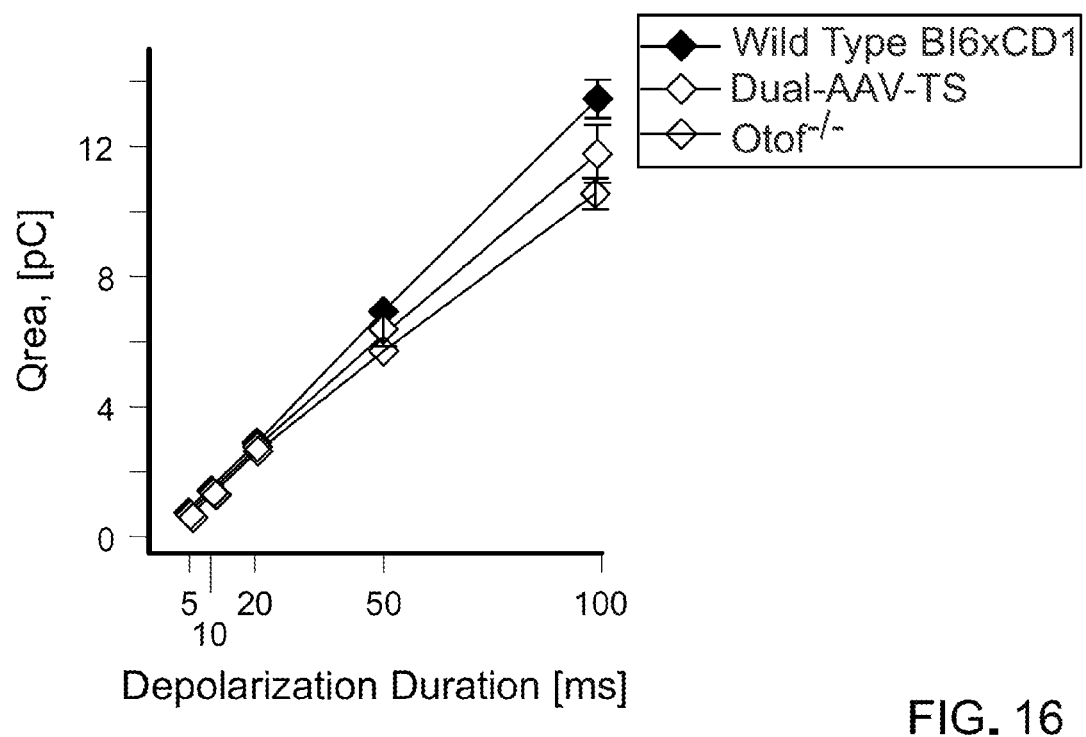
FIG. 16 is a representative graph showing Qreal over the duration of depolarization (ms) in Otof$^{-/-}$ IHCs (white diamond), IHCs of Otof$^{-/-}$ mice transduced with the two vectors shown in FIG. 2 (gray diamonds), and IHCs of background-matched wild-type controls (black diamond).

The data in FIGS. 15 and 16 also show that the hybrid approach (administration of the vectors shown in FIG. 2) also restores otoferlin activity in the IHCs of Otof-mice.

These data indicate that the presently claimed methods can restore hearing in mammals having an inactivating mutation in an otoferlin gene.

Example 17: Restoration of Exocytosis in Response to Short Depolarization Stimuli Restored by Trans-Splicing Dual-AAV Mediated Expression of Otoferlin in IHCs of Otof$^{-/-}$ Mice An experiment was performed to determine whether the presently claimed methods would restore fusion of synaptic vesicles with inner auditory hair cells in Otof$^{-/-}$ mice.

Figure 8:
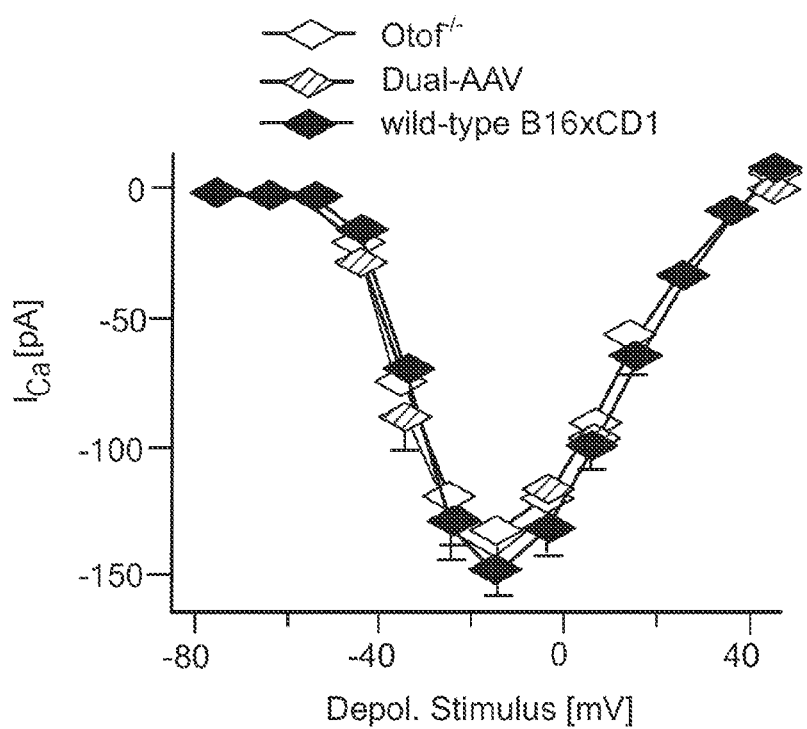
FIG. 8 is a graph showing $Ca^{2+}$ currents over the depolarization stimulus for $Otof^{-/-}$ IHCs (white; n=10), $Otof^{-/-}$ IHC after dual-AAV mediated expression of otoferlin (diagonal line; n=8), and wild-type IHCs from background matched control animals (black; n=6).
Figure 9:
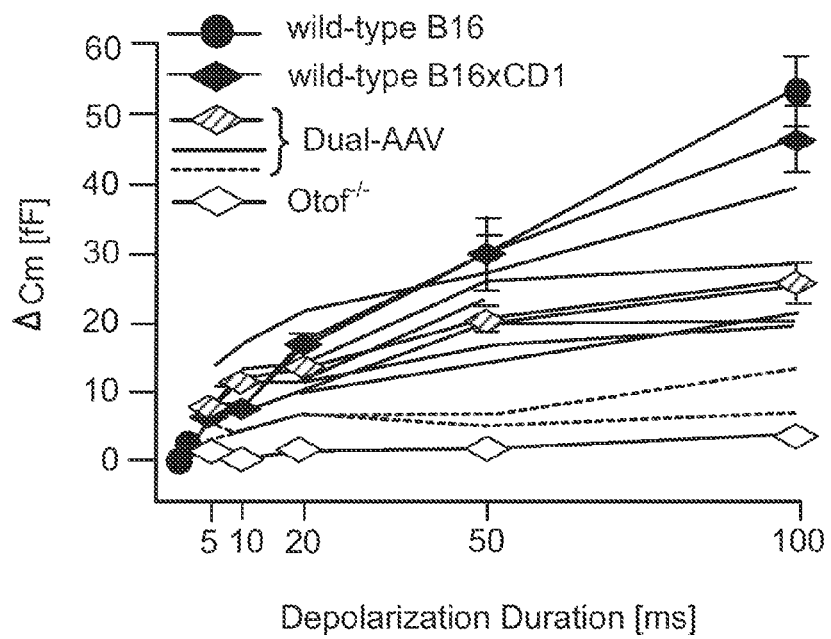
FIG. 9 is a graph showing plasma membrane capacitance ($\Delta C_m$) over the duration of depolarization in dual-AAV transduced IHCs of $Otof^{-/-}$, mice (black line, individual IHCs; diamond with diagonal line fill: mean±s.e.m; n=8), two individual dual-AAV-transduced IHCs from injected Otof$^{-/-}$ mice (dashed line), which displayed only minor amounts of exocytosis, and background-matched wild-type controls (black diamonds; n=6). Wild-type data from Strenzke et al. (2016) EMBO J. 35 2519-2535 is shown with black circles for comparison.
Figure 10:
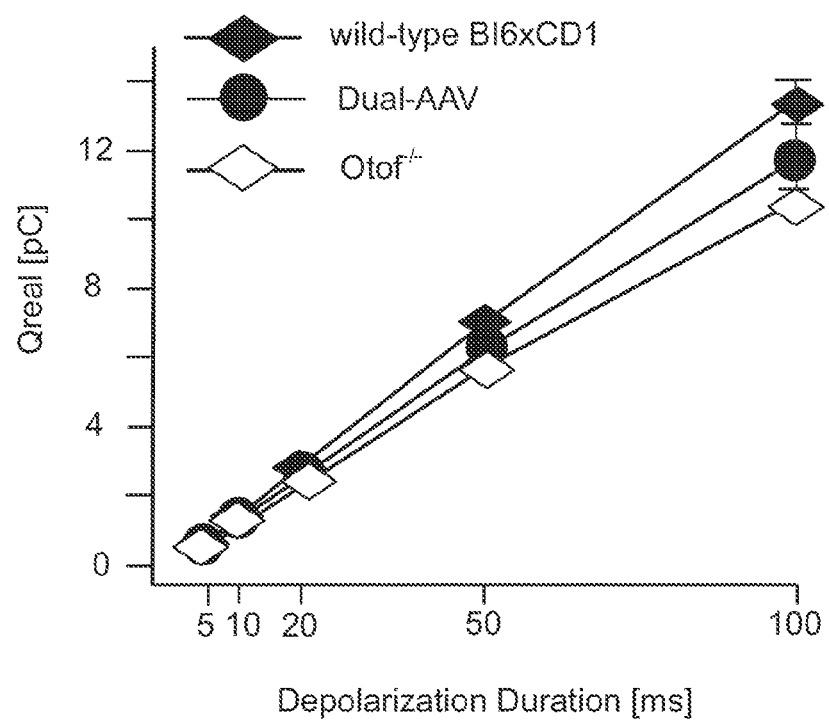
FIG. 10 is a representative graph showing Qreal over the duration of depolarization (ms) in Otof$^{-/-}$ IHCs (white diamond), dual-AAV transduced IHCs of Otof$^{-/-}$ mice (black circle), and background-matched wild-type controls (black diamond).

Since the fusion of synaptic vesicles increases the plasma membrane surface of the cell, this fusion can be measured as an increase in plasma membrane capacitance ($\Delta$Cm). In order to quantify exocytosis of the readily releasable pool of vesicles and sustained exocytosis, the change of plasma membrane capacitance ($\Delta C_m$) was measured in perforated patch-clamp configuration (FIGS. 8-10). Exocytosis was recorded as the change in membrane capacitance after depolarizing the IHC to −14 mV for the indicated duration.

IHCs from acutely explanted organs of Corti of mice were depolarized at postnatal days 14 to 18 (P14-P18) to the voltage where maximum Ca$^{2+}$ currents were elicited, typically −14 mV. Ca$^{2+}$ currents and $\Delta C_m$ from Otof$^{-/-}$ IHCs with and without viral transduction were recorded, with virally transduced IHCs being identified by their eGFP fluorescence during the experiment. Consistent with the synapse numbers in untreated and transduced Otof$^{-/-}$ IHCs, Ca$^{2+}$ currents were found to be comparable in size to those of Otof$^{+/+}$ age- and background matched controls (FIGS. 8 and 10). As shown in FIG. 8, Ca$^{2+}$ currents did not differ in amplitude or gating properties between non-transduced Otof$^{-/-}$ IHCs, dual-AAV transduced IHCs, or wild-type IHCs from background-matched control animals. In response to depolarization pulses of 5 or 10 ms, exocytosis in transduced Otof$^{-/-}$ IHCs was found to be of similar size as in Otof$^{+/+}$ IHCs, while almost no change in C$_m$ could be detected in non-transduced Otof$^{-/-}$ IHCs (FIG. 9). Indeed, for short depolarization stimuli up to 20 ms, exocytosis was wild-type like in dual-AAV transduced IHCs of Otof$^{-/-}$ mice, indicating an intact, readily-releasable pool of vesicles. During sustained depolarization, vesicles of the readily-releasable pool need to be replenished; otoferlin is known to be required for this process (Pangrsic et al. (2010) Nat. Neurosci. 13 869-876; Strenzke et al. (2016) EMBO J. 35 2519-2535). For longer depolarization stimuli, exocytosis was in the range of the mildly hearing impaired Otof$^{I515T/I515T}$ mice (Strenzke et al. (2016) EMBO J. 35 2519-2535). As shown in FIG. 9, for 50-100 ms depolarizations, exocytosis in transduced Otof$^{-/-}$ IHCs was found to be ~60% of Otof$^{+/+}$ IHCs, while non-transduced Otof$^{-/-}$ IHCs showed hardly any vesicle fusion, as previously described (Roux et al. (2006) Cell 127 277-289). The rates of vesicle replenishment were calculated in individual transduced cells. Approximately three hundred and eighty vesicles/sec/active zone were found to undergo exocytosis, compared to 750 vesicles/sec/active zone in Otof$^{+/+}$ IHCs (Strenzke et al. (2016) EMBO J. 35 2519-2535). Thus, in transduced Otof$^{-/-}$ IHCs, the rate of vesicle replenishment to the RRP could be partially recovered and was between that of wild type controls and mildly hearing impaired Otofl515T$^{/1515T}$ mice (Strenzke et al. (2016) EMBO J. 35 2519-2535). As shown in FIG. 10, Ca integrals during the depolarization step indicate that a similar charge of Ca$^{2+}$ entered IHCs in transduced and non-transduced Otof$^{-/-}$ IHCs and in wild-type control cells.

The AAV serotype 6 was chosen, which resulted in IHC transduction rates of up to 51%. The artificial serotype Anc80L65 might, as recently has been shown (Landegger et al. (2017) Nat. Biotechnol. 35 280-284), increase the IHC transduction rate further, especially when applied to more mature ears (Suzuki et al. (2017) Scientific Reports 7 45524).

In sum, these data show that hearing was restored in nine injected Otof−/− animals, using the methods described herein. These data also indicate that hearing thresholds get better the more IHCs express otoferlin.

Example 18: Adeno-Associated Virus (AAV) Trans-Splicing Strategy

At least two different nucleic acid vectors (e.g., AAV vectors) can be used to reconstitute an active otoferlin gene (e.g., a full-length otoferlin gene) within a cell following intermolecular concatamerization and trans-splicing. See, e.g., Yan et al., *Proc. Natl. Acad. Sci. U.S.A.* 97:12; 6716-6721, 2000, incorporated in its entirety herein.

In some examples, two different nucleic acid vectors will be used. A first nucleic acid vector can include a promoter (e.g., any of the promoters described herein), a first coding sequence that encodes an N-terminal portion of an otoferlin protein positioned 3' of the promoter (e.g., any of the sizes of a portion of an otoferlin protein described herein and/or any of the N-terminal portions of an otoferlin protein described herein), and a splicing donor signal sequence positioned at the 3' end of the first coding sequence. A second nucleic acid vector can include a splicing acceptor signal sequence, a second coding sequence that encodes a C-terminal portion of an otoferlin protein (i.e., the entire portion of the otoferlin protein that is not included in the N-terminal portion) positioned at the 3' end of the splicing acceptor signal sequence (e.g., any of the sizes of a portion of an otoferlin protein described herein and/or any of the C-terminal portions of an otoferlin protein described herein), and a polyadenylation sequence at the 3' end of the second coding sequence (e.g., any of the polyadenylation sequences described herein). In some embodiments, each of the encoded portions is at least 30 amino acid residues in length (e.g., at least 50 amino acids, at least 75 amino acids, or at least 100 amino acids in length), the amino acid sequence of each of the encoded portions does not overlap with the sequence of the other encoded portion, and no single vector of the two different vectors encodes an active otoferlin protein (e.g., a full-length otoferlin protein). When the two coding sequences of the two vectors are expressed in a mammalian cell (e.g., any of the mammalian cells described herein), splicing occurs between the splicing donor signal sequence and the splicing acceptor signal sequence, thereby forming a recombined mRNA that encodes an active otoferlin protein (e.g., a full-length otoferlin protein).

In another example, three different nucleic acid vectors can be used. A first nucleic acid vector can include a portion of a promoter sequence (e.g., any of the promoter sequences described herein), a first coding sequence of an otoferlin gene that encodes a first portion of an otoferlin protein (e.g., any of the otoferlin coding sequences described herein) positioned 3' of the promoter, and a first splicing donor signal sequence positioned at the 3' end of the first coding sequence. A second nucleic acid vector can include a first splicing acceptor signal sequence, a second coding sequence of an otoferlin gene that encodes a second portion of an otoferlin protein positioned at the 3' end of the first splicing acceptor signal sequence, and a second splicing donor signal sequence positioned at the 3' end of the second coding sequence (e.g., any of the splicing donor signals described herein). A feature of the second nucleic acid vector will be that self-splicing cannot occur (i.e., splicing will not occur between the second splicing donor signal sequence and the first splicing acceptor signal sequence of the second nucleic acid vector). In some embodiments, the splicing donor signal sequence of the first nucleic acid vector and the second splicing donor signal of the second nucleic acid vector are the same (e.g., any of the splicing donor signals described herein or known in the art). In some embodiments, the first splicing donor signal sequence of the first nucleic acid vector and the second splicing donor signal sequence of the second nucleic acid vector are different (e.g., any of the splicing donor signal sequences described herein or known in the art). A third nucleic acid vector will include a second splicing acceptor signal sequence, a third coding sequence of an otoferlin gene that encodes a third portion of an otoferlin protein positioned at the 3' end of the second splicing acceptor signal sequence, and a polyadenylation sequence positioned at the 3' end of the third coding sequence (e.g., any of the polyadenylation sequences described herein). In such methods where three nucleic acid vectors are used, the first splicing donor sequence and the first splicing acceptor sequence can assemble together and the second slicing donor sequence and the second slicing acceptor sequence can assemble together (recombine), and the portions of otoferlin protein respectively encoded by the first, second, and third coding sequences do not overlap, and when introduced into a mammalian cell (e.g., any of the mammalian cells described herein), splicing occurs between the first splicing donor sequence and the first splicing acceptor sequence, and between the second splicing donor sequence and the second splicing acceptor sequence, to form a spliced nucleic acid that encodes an active otoferlin protein (e.g., a full-length otoferlin protein). Based on the strategies provided above, one skilled in the art would understand how to develop a strategy using four, five, or six different nucleic acid vectors.

In any of the examples of these methods, the amino acid sequence of each of the encoded portions does not overlap with the sequence any of the other encoded portions, and no single vector encodes an active otoferlin protein (e.g., a full-length otoferlin protein).

Each of the at least two different vectors includes a coding sequence that encodes a different portion of an otoferlin protein, each of the encoded portions can be at least 30 amino acids (e.g., between about 30 amino acids to about 1600 amino acids, or any of the other subranges of this range described herein).

In some embodiments, each of the coding sequences can include at least one exon and at least one intron of SEQ ID NO: 12 (e.g., at least two exons and at least one intron, at least two exons and at least two introns, at least three exons and at least one intron, at least three exons and at least two introns, or at least three exons and at least three introns). In some embodiments, each of the at least two different vectors includes a coding sequence that encodes a different portion of an otoferlin protein, each of the encoded portions can encode up to 80% of the amino acid sequence of SEQ ID NO: 5 (e.g., up to 10%, up to 20%, up to 30%, up to 40%, up to 50%, up to 60%, or up to 70% of SEQ ID NO: 5) such that each of the encoded portions is non-overlapping. In some embodiments, each of the at least two different vectors includes a coding sequence that encodes a different portion of an otoferlin protein, each of the encoded portions encoding up to 80% of the amino acid sequence of SEQ ID NO: 5 (e.g., up to 10%, up to 20%, up to 30%, up to 40%, up to 50%, up to 60%, or up to 70% of SEQ ID NO: 5), such that each of the encoded portions is non-overlapping.

Each of the at least two nucleic acid vectors may further include an inverted terminal repeat (ITR) to allow head-to-tail recombination. The ITR will be subsequently removed via splicing. For example, the ITR could be a palindromic double-D ITR as described in Yan et al., *Proc. Natl. Acad. Sci. U.S.A.* 97(12):6716-6721, 2000, incorporated in its entirety herein. For example, the ITR could be a AAV serotype-2 ITR as described in Gosh et al., *Mol. Ther.* 16:124-130, 2008, and Gosh et al., *Human Gene Ther.* 22: 77-83, 2011. Non-limiting examples of splicing acceptor and/or donor signal sequences are known in the art. See, e.g., Reich et al., *Human Gene Ther.* 14(1):37-44, 2003, and Lai et al. (2005) *Nat. Biotechnol.* 23(11):1435-1439, 2005, 2005. The splicing donor and acceptor signal sequences can be any endogenous intron splicing signal of a gene (e.g., an otoferlin gene).

```
For example, the splicing donor signal
sequence can be:
                                 (SEQ ID NO: 64)
5'-GTAAGTATCAAGGTTACAAGACAGGTTTAAGGAGA

CCAATAGAAACTGGGCTTGTCGAGACAGAGAAGACTCT

TGCGTTTCT-3' and the splicing acceptor signal can be:
                                (SEQ ID NO: 110)
5'-ATAGGCACCTATTGGTCTTACTGACATCCACTTTG CCTTTCTCTCCACAG-3'
(see, e.g., Trapani et al., EMBO Mol.
Med. 6(2):194-211, 2014).
```

Methods of evaluating splicing and splicing efficiency are known in the art (see, e.g., Lai et al., *Nat. Biotechnol.* 23(11): 1435-1439, 2005).

Example 19: Hybrid Vector Trans-Splicing Strategy Using an Alkaline Phosphatase (AP) Highly Recombinogenic Exogenous Gene Region At least two (e.g., two, three, four, five, or six) different nucleic acid vectors (e.g., AAV vectors) can also be used in any of the methods described herein to reconstitute an active otoferlin gene (e.g., a full-length otoferlin gene) within a cell following intermolecular concatamerization, marker gene-mediated recombination, and trans-splicing. This strategy is a hybrid strategy as it will include homologous recombination and/or trans-splicing. See, e.g., Gosh et al., *Mol. Ther.* 16: 124-130, 2008; Gosh et al., *Human Gene Ther.* 22: 77-83, 2011; and Duan et al., *Mol. Ther.* 4: 383-391, 2001, each incorporated in its entirety herein. As used herein, a detectable marker gene can be a highly recombinogenic DNA sequence that will allow for coding sequence-independent recombination. An non-limiting example of a detectable marker gene is an alkaline phosphatase (AP) gene. For example, the detectable marker gene can be the middle one-third of the human placental AP complementary DNA, which is 872 bp in length (see, e.g., Gosh et al., 2008). At least two different nucleic acid vectors will contain a detectable marker gene (e.g., any of the detectable marker genes described herein). Since the hybrid vector will be constructed based on a trans-splicing vector as described in Example 18, an active otoferlin gene (e.g., a full-length otoferlin gene) may be reconstituted using either ITR-mediated recombination and trans-splicing or detectable marker gene-mediated (e.g., AP-gene mediated) recombination and trans-splicing. After trans-splicing, an active otoferlin gene (e.g., a full-length otoferlin gene) will be reconstituted in the genomic DNA of a mammalian cell (e.g., any mammalian cell described herein).

In one example, two different nucleic acid vectors will be used. A first nucleic acid vector can include a promoter (e.g., any of the promoters described herein), a first coding sequence that encodes an N-terminal portion of an otoferlin protein positioned 3' of the promoter (e.g., any of the sizes of a portion of an otoferlin protein described herein and/or any of the N-terminal portions of an otoferlin protein described herein), a splicing donor signal sequence positioned at the 3' end of the first coding sequence, and a first detectable marker gene positioned 3' of the splicing donor signal sequence. A second nucleic acid vector can include a second detectable marker gene, a splicing acceptor signal sequence positioned 3' of the second detectable marker gene, a second coding sequence that encodes a C-terminal portion of an otoferlin protein positioned at the 3' end of the splicing acceptor signal sequence (e.g., any of the sizes of a portion of an otoferlin protein described herein and/or any of the C-terminal portions of an otoferlin protein described herein), and a polyadenylation sequence at the 3' end of the second coding sequence (e.g., any of the polyadenylation sequences described herein). In some embodiments, each of the encoded portions is at least 30 amino acid residues in length (e.g., at least 50 amino acids, at least 75 amino acids, or at least 100 amino acids in length), the amino acid sequence of each of the encoded portions do not overlap, and no single vector of the two different vectors encodes an active otoferlin protein (e.g., a full-length otoferlin protein). When introduced into a mammalian cell (e.g., any of the mammalian cells described herein) splicing occurs between the splicing donor signal sequence and the splicing acceptor signal sequence, thereby forming an RNA acid that encodes an active otoferlin protein (e.g., a full-length otoferlin protein).

In another example, three different nucleic acid vectors can be used. A first nucleic acid vector can include a portion of promoter sequence (e.g., any of the promoter sequences described herein), a first coding sequence of an otoferlin gene that encodes a first portion of an otoferlin protein (e.g., any of the otoferlin coding sequences described herein) positioned 3' of the promoter, a first splicing donor signal sequence positioned at the 3' end of the first coding sequence, and a first detectable marker gene. A second nucleic acid vector can include a second detectable marker gene, a first splicing acceptor signal sequence positioned 3' of the second detectable marker gene, a second coding sequence of an otoferlin gene that encodes a second portion of an otoferlin protein positioned at the 3' end of the first splicing acceptor signal sequence, a second splicing donor signal sequence positioned at the 3' end of the second coding sequence (e.g., any of the splicing donor signals described herein), and a third detectable marker gene. A feature of the second nucleic acid vector will be that self-splicing cannot occur (i.e., splicing will not occur between the second splicing donor signal sequence and the first splicing acceptor signal sequence of the second nucleic acid vector). In some embodiments, the splicing donor signal sequence of the first nucleic acid vector and the second splicing donor signal of the second nucleic acid vector are the same (e.g., any of the splicing donor signals described herein or known in the art). In some embodiments, the first splicing donor signal sequence of the first nucleic acid vector and the second splicing donor signal sequence of the second nucleic acid vector are different (e.g., any of the splicing donor signal sequences described herein or known in the art). A third nucleic acid vector can include a fourth detectable marker gene, a second splicing acceptor signal sequence positioned 3' of the fourth detectable marker gene, a third coding sequence of an otoferlin gene that encodes a third portion of an otoferlin protein positioned at the 3' end of the second splicing acceptor signal sequence, and a polyadenylation sequence positioned at the 3' end of the third coding sequence (e.g., any of the polyadenylation sequences described herein). In such methods where three nucleic acid vectors are used, the first splicing donor sequence and the first splicing acceptor sequence can assemble together (recombine) and the second slicing donor sequence and the second slicing acceptor sequence can assemble together (recombine), and the portion of otoferlin protein encoded by the first, second, and third coding sequences do not overlap, and when introduced into a mammalian cell (e.g., any of the mammalian cells described herein), splicing occurs between the first splicing donor sequence and the first splicing acceptor sequence, and between the second splicing donor sequence and the second splicing acceptor sequence, to form a recombined nucleic acid that encodes an active otoferlin protein (e.g., a full-length otoferlin protein). As can be appreciated in the art, when three nucleic acid vectors are used, two of the at least two different nucleic acid vectors can include a detectable marker gene (e.g., an AP marker gene), and one of the at least two different nucleic acid vectors may include a splicing acceptor signal sequence that is complementary to a splicing donor signal sequence in a nucleic acid vector that includes a detectable marker gene. For example, in some embodiments, the first and second nucleic acid vectors can include a detectable marker gene (e.g., an AP marker gene), and the third nucleic acid vector will include a splicing acceptor signal sequence that is complementary to the splicing donor signal sequence in the second nucleic acid vector, and the third nucleic acid vector will not include a detectable marker gene (e.g., an AP marker gene). In other examples, the second and third nucleic acid vector can include a detectable marker gene (e.g., an AP marker gene), and the first nucleic acid vector will include a splicing donor signal sequence that is complementary to the splicing acceptor signal sequence in the second nucleic acid vector and the first nucleic acid vector will not include a detectable marker gene (e.g., an AP marker gene).

Based on the strategies provided above, one skilled in the art would understand how to develop a strategy using four, five, or six vectors.

The coding sequences provided in the at least two nucleic acid vectors (e.g., two, three, four, five or six) will not be overlapping. Each of the at least two different vectors can include a coding sequence that encodes a different portion of an otoferlin protein, each of the encoded portions being, e.g., at least 30 amino acids (e.g., about 30 amino acids to about 1600 amino acids, or any of the other subranges of this range described herein).

In some embodiments, each of the at least two different vectors includes a coding sequence that encodes a different portion of an otoferlin protein, each of the encoded portions encoding at least one exon and at least one intron of SEQ ID NO: 12 (e.g., at least two exons and at least one intron, at least two exons and at least two introns, at least three exons at least one intron, at least three exons and at least two introns, or at least three exons and at least three introns). In some embodiments, each of the at least two different vectors include a coding sequence that encodes a different portion of an otoferlin protein, each of the encoded portions encoding up to 80% of SEQ ID NO: 5 (e.g., up to 10%, up to 20%, up to 30%, up to 40%, up to 50%, up to 60%, or up to 70% of SEQ ID NO: 5) such that each of the encoded portions is non-overlapping. In some embodiments, each of the at least two different vectors include a coding sequence that encodes a different portion of an otoferlin protein, each of the encoded portions encoding up to 80% of SEQ ID NO: 5 (e.g., up to 10%, up to 20%, up to 30%, up to 40%, up to 50%, up to 60%, or up to 70% of SEQ ID NO: 5), such that each of the encoded portions is non-overlapping.

As described in Example 18, each of the at least two nucleic acid vectors may further include an inverted terminal repeat (ITR) to allow head-to-tail recombination. The ITR will be subsequently removed via splicing. Examples of ITRs and splicing acceptor and/or donor signal sequences are known in the art and have been described in Example 18.

Example 20: Hybrid Vector Trans-Splicing Strategy Using a F1 Phage Highly Recombinogenic Exogenous Gene Region (AK)

At least two (e.g., two, three, four, five, or six) different nucleic acid vectors (e.g., AAV vectors) can also be used in any of the methods described herein to reconstitute an active otoferlin gene (e.g., a full-length otoferlin gene) within a cell following intermolecular concatamerization, marker gene-mediated recombination, and trans-splicing. See, e.g., the vectors shown in FIG. 2. This strategy is a hybrid strategy as it will include homologous recombination and/or trans-splicing. See, e.g., Trapani et al., *EMBO Mol. Med.* 6(2): 194-211, 2014, incorporated in its entirety herein. As used herein, an F1 phage recombinogenic region (AK) will be used to allow coding sequence-independent recombination. The F1 phage recombinogenic region may be a 77 bp recombinogenic region from the F1 phage genome as described in Trapani et al. (2014) EMBO Mol. Med. 6(2): 194-211, 2014. At least two different nucleic acid vectors will contain an F1 phage recombinogenic region. Since the hybrid vector will be constructed based on a trans-splicing vector as described in Example 18, a nucleic acid encoding an active otoferlin protein (e.g., a full-length stereocilin protein) may be generated using either ITR-mediated recombination and trans-splicing or F1 phage recombinogenic region-induced recombination and trans-splicing. After trans-splicing, a nucleic acid encoding an active otoferlin protein (e.g., a full-length otoferlin protein) will be generated in a mammalian cell (e.g., any of the mammalian cells described herein).

In one example, two different nucleic acid vectors will be used. A first nucleic acid vector can include a promoter (e.g., any of the promoters described herein), a first coding sequence that encodes an N-terminal portion of an otoferlin protein positioned 3' of the promoter (e.g., any of the sizes of a portion of an otoferlin protein described herein and/or any of the N-terminal portions of an otoferlin protein described herein), a splicing donor signal sequence positioned at the 3' end of the first coding sequence, and an F1 phage recombinogenic region positioned 3' of the splicing donor signal sequence. A second nucleic acid vector can include an F1 phage recombinogenic region, a splicing acceptor signal sequence positioned 3' of the F1 phage recombinogenic region, a second coding sequence that encodes a C-terminal portion of an otoferlin protein positioned at the 3' end of the splicing acceptor signal sequence (e.g., any of the sizes of a portion of an otoferlin protein described herein and/or any of the C-terminal portions of an otoferlin protein described herein), and a polyadenylation sequence at the 3' end of the second coding sequence (e.g., any of the polyadenylation sequences described herein). In some embodiments, each of the encoded portions is at least 30 amino acid residues in length (e.g., at least 50 amino acids, at least 75 amino acids, or at least 100 amino acids in length), the amino acid sequence of each of the encoded portions do not overlap, and no single vector of the two different vectors encodes an active otoferlin protein (e.g., a full-length otoferlin protein). When the vectors are introduced into a mammalian cell (e.g., any of the mammalian cells described herein), splicing occurs between the splicing donor signal sequence and the splicing acceptor signal sequence, thereby forming a recombined nucleic acid that encodes an active otoferlin protein (e.g., a full-length otoferlin protein).

In another example, three different nucleic acid vectors will be used. A first nucleic acid vector can include a portion of promoter sequence (e.g., any of the promoter sequences described herein), a first coding sequence of an otoferlin gene that encodes a first portion of an otoferlin protein (e.g., any of the otoferlin coding sequences described herein) positioned 5' of the promoter, a first splicing donor signal sequence positioned at the 3' end of the first coding sequence, and an F1 phage recombinogenic region. A second nucleic acid vector can include an F1 phage recombinogenic region, a first splicing acceptor signal sequence positioned 3' of the F1 phage recombinogenic region, a second coding sequence of an otoferlin gene that encodes a second portion of an otoferlin protein positioned at the 3' end of the first splicing acceptor signal sequence, a second splicing donor signal sequence positioned at the 3' end of the second coding sequence (e.g., any of the splicing donor signals described herein), and an F1 phage recombinogenic region. A feature of the second nucleic acid vector will be that self-splicing cannot occur (i.e., splicing will not occur between the second splicing donor signal sequence and the first splicing acceptor signal sequence of the second nucleic acid vector). In some embodiments, the splicing donor signal sequence of the first nucleic acid vector and the second splicing donor signal of the second nucleic acid vector are the same (e.g., any of the splicing donor signals described herein or known in the art). In some embodiments, the first splicing donor signal sequence of the first nucleic acid vector and the second splicing donor signal sequence of the second nucleic acid vector are different (e.g., any of the splicing donor signal sequences described herein or known in the art). A third nucleic acid vector can include an F1 phage recombinogenic region, a second splicing acceptor signal sequence positioned 3' of the F1 phage recombinogenic region, a third coding sequence of an otoferlin gene that encodes a third portion of an otoferlin protein positioned at the 3' end of the second splicing acceptor signal sequence, and a polyadenylation sequence positioned at the 3' end of the third coding sequence (e.g., any of the polyadenylation sequences described herein). In such methods where three nucleic acid vectors are used, the first splicing donor sequence and the first splicing acceptor sequence can assemble together (recombine) and the second slicing donor sequence and the second slicing acceptor sequence can assemble together (recombine), and the portion of otoferlin protein encoded by the first, second, and third coding sequences do not overlap, and when introduced into a mammalian cell (e.g., any of the mammalian cells described herein), splicing occurs between the first splicing donor sequence and the first splicing acceptor sequence, and between the second splicing donor sequence and the second splicing acceptor sequence, to form a recombined nucleic acid that encodes an active otoferlin protein (e.g., a full-length otoferlin protein). As can be appreciated in the art when three nucleic acid vectors are used, two of the different nucleic acid vectors can include an F1 phage recombinogenic region and one of the different nucleic acid vectors may include a splicing acceptor signal sequence that is complementary to a splicing donor signal sequence in a nucleic acid vector that includes an F1 phage recombinogenic region. For example, in some embodiments, the first and second nucleic acid vectors can include an F1 phage recombinogenic region, and the third nucleic acid vector will include a splicing acceptor signal that is complementary to the splicing donor signal sequence in the second nucleic acid vector, and the third nucleic acid vector will not include an F1 phage recombinogenic region (e.g., an AP marker gene). In other examples, the second and third nucleic acid vector can include an F1 phage recombinogenic region and the first nucleic acid vector will include a splicing donor signal sequence that is complementary to the splicing acceptor signal sequence in the second nucleic acid vector and the first nucleic acid vector will not include an F1 phage recombinogenic region. Based on the strategies provided above, one skilled in the art would understand how to develop a strategy using four, five, or six vectors.

The coding sequences provided in each of the at least two nucleic acid vectors (e.g., two, three, four, five or six) will not be overlapping. Each of the at least two different vectors include a coding sequence that encodes a different portion of an otoferlin protein, each of the encoded portions being at least 30 amino acids (e.g., about 30 amino acids to about 1600 amino acids, or any of the subranges of this range described herein).

In some embodiments, each of the at least two different vectors include a coding sequence that encodes a different portion of an otoferlin protein, each of the encoded portions encoding at least one exon and at least one intron of SEQ ID NO: 12 (e.g., at least two exons and at least one intron, at least two exons and at least two introns, at least three exons at least one intron, at least three exons and at least two introns, or at least three exons and at least three introns). In some embodiments, each of the at least two different vectors includes a coding sequence that encodes a different portion of an otoferlin protein, each of the encoded portions encoding up to 80% of SEQ ID NO: 5 (e.g., up to 10%, up to 20%, up to 30%, up to 40%, up to 50%, up to 60%, or up to 70% of SEQ ID NO: 5) such that each of the encoded portions is non-overlapping. In some embodiments, each of the at least two different vectors include a coding sequence that encodes a different portion of an otoferlin protein, each of the encoded portions encoding up to 80% of SEQ ID NO: 5 (e.g., up to 10%, up to 20%, up to 30%, up to 40%, up to 50%, up to 60%, or up to 70% of SEQ ID NO: 5), such that each of the encoded portions is non-overlapping.

As described in Example 18 each of the at least two nucleic acid vectors may further include an inverted terminal repeat (ITR) to allow head-to-tail recombination. The ITR will be subsequently removed via splicing. Examples of ITRs and splicing acceptor and/or donor signals are known in the art and have been described in Example 18.

These methods have been used to improve hearing in five animals. The data in FIGS. 15 and 16 show that the Otof$^{-/-}$ mice administered the vectors shown in FIG. 2 restores otoferlin function in the IICs of Otof$^{-/-}$ mice.

Example 21: In Vitro Expression of Full-Length Human Otoferlin Using Two Vectors A variety of different vectors were generated which each include a nucleic acid sequence that encodes a portion of otoferlin: p109 (SEQ ID NO: 84), which is shown in FIG. 38; p105 (SEQ ID NO: 85), which is shown in FIG. 39;

WPRE, which is shown in FIG. 40; p108, which is shown in FIG. 41; 1OTOF18.CL1, which is shown in FIG. 42; 19OTOF48, which is shown in FIG. 43; 1OTOF20.CL1, which is shown in FIG. 44; 21OTOF48.WPRE, which is shown in FIG. 45; 1OTOF21.CL1, which is shown in FIG. 46; and 22OTOF48.WPRE, which is shown in FIG. 47; 105.pA.NTF3.CMVd, which is shown in FIG. 48.

Figure 49:
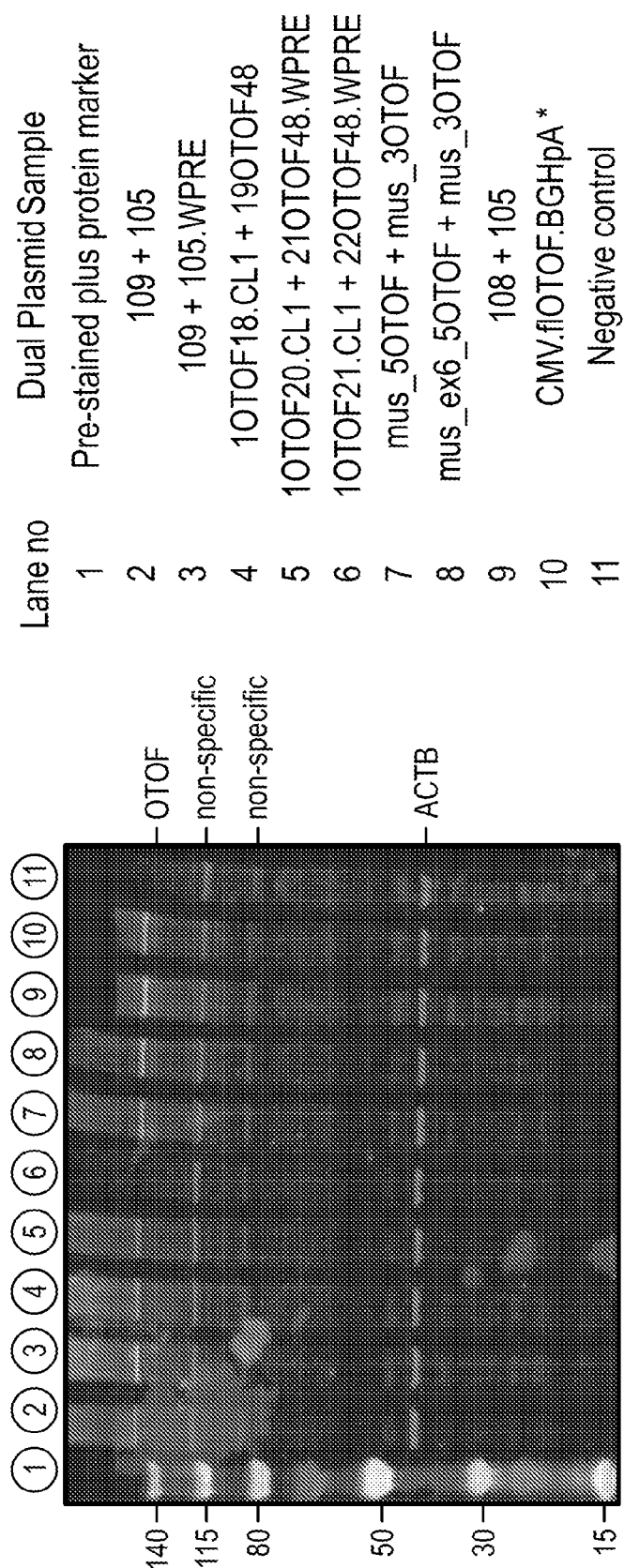
FIG. 49 is an immunoblot showing the expression of full-length human otoferlin in HEK293FT cells transfected with the different pairs of plasmids indicated.

Pairs of these vectors were used to transfect HEK293FT cells. In these experiments, $1.2 \times 10^5$ cells/well were seeded in a 24-well plate overnight at 37° C. with 5% $CO_2$. On the next day, pairs of linearized ITR containing plasmids (the pairs shown in FIG. 49) were transfected into the HEK293FT cells using JetPrime reagent (Polyplus). Seventy-two hours post-transfection, the cells were harvested and lysed using RIPA buffer and analyzed in 4-12% Bolt protein gel. The gel was transferred onto nitrocellulose membrane and blotted with anti-OTOF polyclonal antibody (Thermo PA5-52935). Anti-human beta-actin monoclonal antibody was used as the primary antibody for internal-loading control between the lanes. Three independent in vitro experiments were performed to analyze and compare the expression of full-length protein using various recombination strategies relative to single plasmid CMV.fl-OTOF transfection (lane 10).

Figure 51:
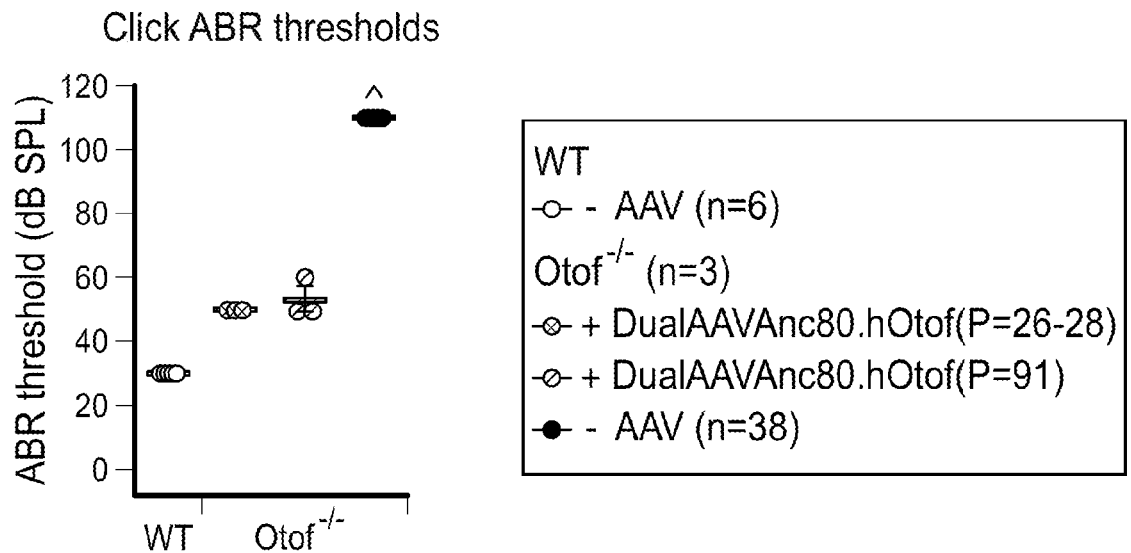
FIG. 51 is a graph of the click ABR threshold in wildtype not treated with a vector or Otof$^{-/-}$ mice not treated with a vector or treated with DualAAV Anc80.hOtof vectors (p105 and p109 vectors). Hearing in the Otof$^{-/-}$ mice administered the DualAAV Anc80.hOtof vectors (p105 and 109 vectors) was measured at 26-28 days and 91 days after treatment.

Compared to the negative control, expression of full-length otoferlin protein (approximately 226 kD) were observed in every lane except lane number 6 (FIGS. 50 and 51).

Example 22: In Vivo Recovery of Hearing Function in OTOF$^{-/-}$ Mice Using Two Vectors A set of experiments were performed to determine whether hearing function could be recovered in Otof$^{-/-}$ mice that have two vectors (p109 and p105; SEQ ID NOs: 84 and 85, respectively) introduced into their cochlea. Briefly, a virus preparation (e.g., $1\text{-}2 \times 10^{10}$ vg/μL) was injected through the auditory bulla covering the round window membrane (RWM) into the scala tympani of the left cochlea at approximately postnatal day 6-7 (P6-7). See, e.g., Jung et al. (2015) *EMBO J* 34: 2686-2702, and Al-Moyed et al. (2019) *EMBO Molecular Medicine* 11(1). pii: e9396. Prior to injection, all mice were anesthetized via isoflurane and were locally anesthetized, e.g., with xylocaine pumpspray, before retroauricular incision.

Auditory brainstem responses (ABRs) were recorded from approximately 3- to 4-week old anesthetized mice subjected to 4, 6, 8, 12, 16, 24, or 32 kHz tone burst (e.g., 10 ms plateau, 1 ms $\cos^2$ rise/fall or 0.03 ms broadband click sound stimuli presented at 20 Hz. See, e.g., Jing et al. (2013) *J Neurosci* 33: 4456-4467. Ears that were injected were clogged with an electrode gel while ABRs were recorded from contralateral non-injected ears.

ABR click sound thresholds were determined as the lowest sound pressure levels necessary to evoke reproducible ABR wave response and were measured in 10 decibel sound pressure levels (dB SPL) steps from 30 dB SPL to 100 dB SPL. Tone burst thresholds were recorded in 10 dB SPL steps from 10 dB SPL below the lowest reproducible ABR and up to 90 dB SPL. ABR wave I was defined as the first distinguishable peak between the summating receptor potential (SP) and the prominent ABR wave II peak. The amplitude of each ABR wave was calculated as the difference between the highest point of a wave and the subsequent local minimum. The summed ABR wave I-V amplitude was calculated by adding up the individual amplitude values of ABR waves I-V.

Figure 52:
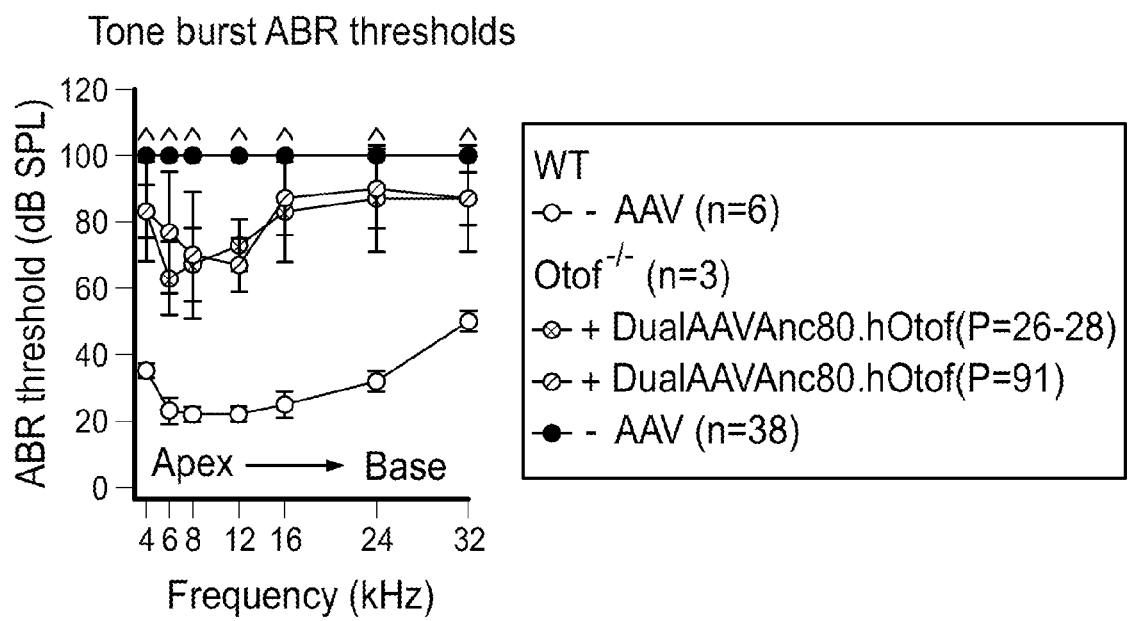
FIG. 52 is a graph of the tone burst ABR threshold in wildtype not treated with a vector or Otof$^{-/-}$ mice not treated with a vector or treated with DualAAV Anc80.hOtof vectors (p105 and p109 vectors). Hearing in the Otof$^{-/-}$ mice administered the DualAAV Anc80.hOtof vectors (p105 and 109 vectors) was measured at 26-28 days and 91 days after treatment.

The click ABR threshold and the tone burst ABR threshold were determined in wildtype mice that were not treated, Otof$^{-/-}$ that were not treated, and Otof$^{-/-}$ mice that were treated with the two vectors (p109 and p105). Hearing function was tested in the treated Otof$^{-/-}$ at days 26-28 and day 91 after administration. The data show that Otof$^{-/-}$ mice demonstrated significant improvements in hearing function after treatment with the two vectors, as compared to untreated Otof$^{-/-}$ mice (FIGS. 51 and 52).

Example 23: In Vivo Recovery of Hearing Function in Human Subjects Using Two Vectors A set of experiments are performed to determine whether hearing function could be recovered in human subjects that have two vectors (p109 and p105; SEQ ID NOs: 84 and 85, respectively) introduced into their cochlea. Hearing function is tested in the human subject at days 15, 30, 45, 60 and 90 after administration, and is compared to the functional hearing of human subject that did not receive treatment.

Example 24: In Vitro Expression of Full-Length Human Otoferlin Using Two Vectors As in other dual vector approaches, two transgenes, each comprising a portion of the full-length transcript, are packaged in separate vectors and provided, together, to contact a target, e.g., a target cell population in, e.g., a subject in need thereof. The present example provides a set of vectors which were generated to each include a nucleic acid sequence that comprises a portion of the coding sequence of the human otoferlin (OTOF) gene or OTOF cDNA. The overall structure and components of the "upstream" AKhOTOF5 vector are shown in FIG. 79. The full 5'ITR-to-3'ITR sequence is represented by SEQ ID NO: 96. The sequences of the individual components in the order they are found from 5'ITR-to-3'ITR are provided in Table 1 below. The overall structure and components of the "downstream" AKhOTOF3 vector are shown in FIG. 80. The full 5'ITR-to-3'ITR sequence is represented by SEQ ID NO: 105. The sequences of the individual components in the order they are found from 5'ITR-to-3'ITR are provided in Table 2 below. A schematic of the dual AAV vector system is shown in FIG. 78. An Anc80 capsid (SEQ ID NO: 109; see Table 3 below) independently encapsidates the upstream vector (Anc80.AKhOTOF5) and the downstream vector (Anc80.AKhOTOF3). In some embodiments, when each of the upstream and downstream vectors is administered to a subject in need thereof, the constructs concatemerize within a given cell. In some such embodiments, concatemerized full-length OTOF is expressed and generates functional otoferlin protein.

Pairs of these vectors are used to treat a human subject suffering from or susceptible to hearing loss. A composition comprising both vectors of the dual AAV vector system, Anc80.AKhOTOF5 and Anc80.AKhOTOF3, is introduced into at least one cochlea of the human subject. Hearing function is tested in the human subject at days 15, 30, 45, 60 and 90 after administration, and is compared to the functional hearing of the human subject prior to receiving treatment or to a human subject that did not receive treatment.

AKhOTOF5

The AKhOTOF5 construct comprises two ITRs (SEQ ID NO: 97 and 104), a CAG promoter (identified by SEQ ID NOs: 98, 99, and 100, comprising a CMV early enhancer element, chicken beta actin gene sequence, and a chimeric intron comprising 3' splice sequence from the rabbit beta globin gene, respectively), a 5'OTOF coding region (SEQ ID NO: 101), a SD intron sequence (SEQ ID NO: 102), and an AK recombinogenic sequence (SEQ ID NO: 103). The full-length AKhOTOF5 is represented by SEQ ID NO: 96.

TABLE 1

| | AKhOTOF5 | |
|---|---|---|
| Name | SEQUENCE | SEQ ID NO |
| AKhOTOF5 | TTGGCCACTCCCTCTCTGCGCGCTCGCTCGCTCACTGAGGCCGCC CGGGCAAAGCCCGGGCGTCGGGCGACCTTTGGTCGCCCGGCCTCA GTGAGCGAGCGAGCGCGCAGAGAGGGAGTGGCCAACTCCATCACT AGGGGTTCCTTTGTCGACGCGGCCGCACGCGTGACATTGATTATT GACTAGTTATTAATAGTAATCAATTACGGGGTCATTAGTTCATAG CCCATATATGGAGTTCCGCGTTACATAACTTACGGTAAATGGCCC GCCTGGCTGACCGCCCAACGACCCCCGCCCATTGACGTCAATAAT GACGTATGTTCCCATAGTAACGCCAATAGGGACTTTCCATTGACG TCAATGGGTGGACTATTTACGGTAAACTGCCCACTTGGCAGTACA TCAAGTGTATCATATGCCAAGTACGCCCCCTATTGACGTCAATGA CGGTAAATGGCCCGCCTGGCATTATGCCCAGTACATGACCTTATG GGACTTTCCTACTTGGCAGTAGATCTACGTATTAGTCATCGCTAT TACCATGGGTCGAGGTGAGCCCCACGTTCTGCTTCACTCTCCCCA TCTCCCCCCCCTCCCCACCCCCAATTTTGTATTTATTTATTTTTT AATTATTTTGTGCAGCGATGGGGCGGGGGGGGGGGGGGGCGCG CGCCAGGCGGGGCGGGGCGGGGCGAGGGGCGGGGCGGGGCGAGGC GGAGAGGTGCGGCGGCAGCCAATCAGAGCGGCGCGCTCCGAAAGT TTCCTTTTATGGCGAGGCGGCGGCGGCGGCGGCCCTATAAAAAGC GAAGCGCGCGGCGGGCGGGAGTCGCTGCGTTGCCTTCGCCCCGTG CCCCGCTCCGCGCCGCCTCGCGCCGCCCGCCCCGGCTCTGACTGA CCGCGTTACTCCCACAGGTGAGCGGGCGGGACGGCCCTTCTCCTC CGGGCTGTAATTAGCGCTTGGTTTAATGACGGCTCGTTTCTTTTC TGTGGCTGCGTGAAAGCCTTAAAGGGCTCCGGGAGGGCCCTTTGT GCGGGGGGGAGCGGCTCGGGGGGTGCGTGCGTGTGTGTGTGCGTG GGGAGCGCCGCGTGCGGCCCGCGCTGCCCGGCGGCTGTGAGCGCT GCGGGCGCGGCGCGGGGCTTTGTGCGCTCCGCGTGTGCGCGAGGG GAGCGCGGCCGGGGCGGTGCCCCGCGGTGCGGGGGGGCTGCGAG GGGAACAAAGGCTGCGTGCGGGGTGTGTGCGTGGGGGGGTGAGCA GGGGGTGTGGGCGCGGCGGTCGGGCTGTAACCCCCCCCTGCACCC CCCTCCCCGAGTTGCTGAGCACGGCCCGGCTTCGGGTGCGGGGCT CCGTGCGGGGCGTGGCGCGGGGCTCGCCGTGCCGGGCGGGGGGTG GCGGCAGGTGGGGGTGCCGGGCGGGGCGGGGCCGCCTCGGGGCCGG GGAGGGCTCGGGGAGGGGCGCGGCGGCCCCCGGAGCGCCGGCGG CTGTCGAGGCGCGGCGAGCCGCAGCCATTGCCTTTTATGGTAATC GTGCGAGAGGGCGCAGGGACTTCCTTTGTCCCAAATCTGTGCGGA GCCGAAATCTGGGAGGCGCCGCCGCACCCCCTCTAGCGGGCGCGG GGCGAAGCGGTGCGGCGCCGGCAGGAAGGAAATGGGCGGGAGGG CCTTCGTGCGTCGCCGCGCCGCCGTCCCCTTCTCCCTCTCCAGCC TCGGGGCTGTCCGCGGGGGGACGGCTGCCTTCGGGGGGGACGGGG CAGGGCGGGGTTCGGCTTCTGGCGTGTGACCGGCGGCTCTAGAGC CTCTGCTAACCATGTTCATGCCTTCTTCTTTTTCCTACAGCTCCT GGGCAACGTGCTGGTTATTGTGACCGGTGCCACCATGGCCTTGCT CATCCACCTCAAGACAGTCTCGGAGCTGCGGGCAGGGCGACCG GATCGCCAAAGTGACTTTCCGAGGGCAATCCTTCTACTCTCGGGT CCTGGAGAACTGTGAGGATGTGGCTGACTTTGATGAGACATTTCG GTGGCCGGTGGCCAGCAGCATCGACAGAAATGAGATGCTGGAGAT TCAGGTTTTCAACTACAGCAAAGTCTTCAGCAACAAGCTCATCGG GACCTTCCGCATGGTGCTGCAGAAGGTGGTAGAGGAGAGCCATGT GGAGGTGACTGACACGCTGATTGATGACAACAATGCTATCATCAA GACCAGCCTGTGCGTGGAGGTCCGGTATCAGGCCACTGACGGCAC AGTGGGCTCCTGGGACGATGGGGACTTCCTGGGAGATGAGTCTCT TCAAGAGGAAGAGAAGGACAGCCAAGAGACGGATGGACTGCTCCC AGGCTCCCGGCCCAGCTCCCGGCCCCCAGGAGAGAAGAGCTTCCG GAGAGCCGGGAGGAGCGTGTTCTCCGCCATGAAGCTCGGCAAAAA CAGGTCTCACAAGGAGGAGCCCCAAAGACCAGATGAACCGGCGGT GCTGGAGATGGAAGACCTTGACCATCTGGCCATTCGGCTAGGAGA TGGACTGGATCCCGACTCGGTGTCTCTAGCCTCAGTCACAGCTCT CACCACTAATGTCTCCAACAAGCGATCTAAGCCAGACATTAAGAT GGAGCCAAGTGCTGGGCGGCCCATGGATTACCAGGTCAGCATCAC GGTGATCGAGGCCCGGCAGCTGGTGGGCTTGAACATGGACCCTGT GGTGTGCGTGGAGGTGGGTGACGACAAGAAGTACACATCCATGAA GGAGTCCACTAACTGCCCCTATTACAACGAGTACTTCGTCTTCGA CTTCCATGTCTCTCCGGATGTCATGTTTGACAAGATCATCAAGAT TTCGGTGATTCACTCCAAGAACCTGCTGCGCAGTGGCACCCTGGT GGGCTCCTTCAAAATGGACGTGGGAACCGTGTACTCGCAGCCAGA GCACCAGTTCCATCACAAGTGGGCCATCCTGTCTGACCCCGATGA CATCTCCTCGGGGCTGAAGGGCTACGTGAAGTGTGACGTTGCCGT GGTGGGCAAAGGGACAACATCAAGACGCCCCACAAGGCCAATGA GACCGACGAAGATGACATTGAGGGGAACTTGCTGCTCCCCGAGGG GGTGCCCCCGAACGCCAGTGGGCCCGGTTCTATGTGAAAATTTA CCGAGCAGAGGGGCTGCCCCGTATGAACACAAGCCTCATGGCCAA TGTAAAGAAGGCTTTCATCGGTGAAAACAAGGACCTCGTGGACCC CTACGTGCAAGTCTTCTTTGCTGGCCAGAAGGGCAAGACTTCAGT GCAGAAGAGCAGCTATGAGCCCCTGTGAATGAGCAGGTCGTCTT TACAGACCTCTTCCCCCCACTCTGCAAACGCATGAAGGTGCAGAT | 96 |

TABLE 1-continued

AKhOTOF5

| Name | SEQUENCE | SEQ ID NO |
|---|---|---|
| | CCGAGACTCGGACAAGGTCAACGACGTGGCCATCGGCACCCACTT<br>CATTGACCTGCGCAAGATTTCTAATGACGGAGACAAAGGCTTCCT<br>GCCCACACTGGGCCCAGCCTGGGTGAACATGTACGGCTCCACACG<br>TAACTACACGCTGCTGGATGAGCATCAGGACCTGAACGAGGGCCT<br>GGGGGAGGGTGTGTCCTTCCGGGCCCGGCTCCTGCTGGGCCTGGC<br>TGTGGAGATCGTAGACACCTCCAACCCTGAGCTCACCAGCTCCAC<br>AGAGGTGCAGGTGGAGCAGGCCACGCCCATCTCGGAGAGCTGTGC<br>AGGTAAAATGGAAGAATTCTTTCTCTTTGGAGCCTTCCTGGAGGC<br>CTCAATGATCGACCGGAGAAACGGAGACAAGCCCATCACCTTTGA<br>GGTCACCATAGGCAACTATGGGAACGAAGTTGATGGCCTGTCCCG<br>AGTAGACCTGATTCAGAACGCAAGTGATGACGAGGCCGGTGATGC<br>CGGGGACCTGGCCTCAGTCTCCTCCACTCCACCAATGCGGCCCCA<br>GGTCACCGACAGGAACTACTTCCATCTGCCCTACCTGGAGCGAAA<br>GCCCTGCATCTACATCAAGAGCTGGTGGCCGGACCAGCGCCGCCG<br>CCTCTACAATGCCAACATCATGGACCACATTGCCGACAAGCTGGA<br>AGAAGGCCTGAACGACATACAGGAGATGATCAAAACGAGAAGTC<br>CTACCCTGAGCGTCGCCTGCGGGCGTCCTGGAGGAGCTGAGCTG<br>TGGCTGCTGCCGCTTCCTCTCCCTCGCTGACAAGGACCAGGGCCA<br>CTCATCCCGCACCAGGCTTGACCGGGAGCGCCTCAAGTCCTGCAT<br>GAGGGAGCTGGAAAACATGGGGCAGCAGGCCAGGATGCTGCGGGC<br>CCAGGTGAAGCGGCACACGGTGCGGGACAAGCTGAGGCTGTGCCA<br>GAACTTCCTGCAGAAGCTGCGCTTCCTGGCGGACGAGGTAAGTAT<br>CAAGGTTACAAGACAGGTTTAAGGAGACCAATAGAAACTGGGCTT<br>GTCGAGACAGAGAAGACTCTTGCGTTTCTGGGATTTTGCCGATTT<br>CGGCCTATTGGTTAAAAAATGAGCTGATTTAACAAAATTTAACG<br>CGAATTTTAACAAAATAAGCTTGAATTCAGCTGAGGTGCCTCGGA<br>CCGCCTAGGAGGAACCCCTAGTGATGGAGTTGGCCACTCCCTCTC<br>TGCGCGCTCGCTCGCTCACTGAGGCCGGGCGACCAAAGGTCGCCC<br>GACGCCCGGGCTTTGCCCGGGCGGCCTCAGTGAGCGAGCGAGCGC<br>GCAGAGAGGGAGTGGCCAA | |
| 5'ITR | TTGGCCACTCCCTCTCTGCGCGCTCGCTCGCTCACTGAGGCCGCC<br>CGGGCAAAGCCCGGGCGTCGGGCGACCTTTGGTCGCCCGGCCTCA<br>GTGAGCGAGCGAGCGCGCAGAGAGGGAGTGGCCAACTCCATCACT<br>AGGGGTTCCT | 97 |
| CMV enhancer | GACATTGATTATTGACTAGTTATTAATAGTAATCAATTACGGGGT<br>CATTAGTTCATAGCCCATATATGGAGTTCCGCGTTACATAACTTA<br>CGGTAAATGGCCCGCCTGGCTGACCGCCCAACGACCCCCGCCCAT<br>TGACGTCAATAATGACGTATGTTCCCATAGTAACGCCAATAGGGA<br>CTTTCCATTGACGTCAATGGGTGGACTATTTACGGTAAACTGCCC<br>ACTTGGCAGTAGATCAAGTGTATCATATGCCAAGTACGCCCCCTA<br>TTGACGTCAATGACGGTAAATGGCCCGCCTGGCATTATGCCCAGT<br>ACATGACCTTATGGGACTTTCCTACTTGGCAGTAGATCTAGGTAT<br>TAGTCATCGCTATTACCATGG | 98 |
| CBA gene sequence | GTCGAGGTGAGCCCCACGTTCTGCTTCACTCTCCCCATCTCCCCC<br>CCCTCCCCACCCCCAATTTTGTATTTATTTATTTTTTAATTATTT<br>TGTGCAGCGATGGGGGCGGGGGGGGGGGGGGCGCGCGCCAGGC<br>GGGGCGGGGCGGGGCGAGGGGCGGGGCGGGGCGAGGCGGAGAGGT<br>GCGGCGGCAGCCAATCAGAGCGGCGCGCTCCGAAAGTTTCCTTTT<br>ATGGCGAGGCGGCGGCGGCGGCGGCCCTATAAAAAGCGAAGCGCG<br>CGGCGGGCG | 99 |
| Chimeric intron | GGAGTCGCTGCGTTGCCTTCGCCCCGTGCCCCGCTCCGCGCCGCC<br>TCGCGCCGCCCGCCCCGGCTCTGACTGACCGCGTTACTCCCACAG<br>GTGAGCGGGCGGGACGGCCCTTCCTCCTCCGGGCTGTAATTAGCGC<br>*TTG*GTTTAATGACGGCTCGTTTCTTTTCTGTGGCTGCGTGAAAGC<br>CTTAAAGGGCTCCGGAGGGCCCTTTGTGCGGGGGGAGCGGCTC<br>GGGGGGTGCGTGCGTGTGTGTGCGTGGGGAGCGCCGCGTGCGG<br>CCCGCGCTGCCCGGCGGCTGTGAGCGCTGCGGGCGCGGCGCGGGG<br>CTTTGTGCGCTCCGCGTGTGCGCGAGGGGAGCGCGGCCGGGGCG<br>GTGCCCCGCGGTGCGGGGGGCTGCGAGGGGAACAAAGGCTGCGT<br>GCGGGGTGTGTGCGTGGGGGGGTGAGCAGGGGGTGTGGGCGCGGC<br>GGTCGGGCTGTAACCCCCCCTGCACCCCCCTCCCCGAGTTGCTG<br>AGCACGGCCCGGCTTCGGGTGCGGGGCTCCGTGCGGGGCGTGGCG<br>CGGGGCTCGCCGTGCCGGGCGGGGGTGGCGGCAGGTGGGGGGTGC<br>CGGGCGGGGCGGGGCCGCCTCGGGCCGGGGAGGGCTCGGGGAGG<br>GGCGCGGCGGCCCCCGGAGCGCCGGCGGCTGTCGAGGCGCGGCGA<br>GCCGCAGCCATTGCCTTTTATGGTAATCGTGCGAGAGGGCGCAGG<br>GACTTCCTTTGTCCCAAATCTGTGCGGAGCCGAAATCTGGGAGGC<br>GCCGCCGCACCCCCTCTAGCGGGCGCGGGGCGAAGCGGTGCGGCG<br>CCGGCAGGAAGGAAATGGGCGGGAGGGCCTTCGTGCGTCGCCGC | 100 |

TABLE 1-continued

AKhOTOF5

| Name | SEQUENCE | SEQ ID NO |
|---|---|---|
| | GCCGCCGTCCCCTTCTCCCTCTCCAGCCTCGGGGCTGTCCGCGGG<br>GGGACGGCTGCCTTCGGGGGGACGGGGCAGGGCGGGGTTCGGCT<br>TCTGGCGTGTGACCGGCGGCTCTAGAGCCTCTGCTAACCATGTTC<br>ATGCCTTCTTCTTTTTCCTACAG | |
| 5'OTOF | ATGGCCTTGCTCATCCACCTCAAGACAGTCTCGGAGCTGCGGGGC<br>AGGGGCGACCGGATCGCCAAAGTGACTTTCCGAGGGCAATCCTTC<br>TACTCTCGGGTCCTGGAGAACTGTGAGGATGTGGCTGACTTTGAT<br>GAGACATTTCGGTGGCCGGTGGCCAGCAGCATCGACAGAAATGAG<br>ATGCTGGAGATTCAGGTTTTCAACTACAGCAAAGTCTTCAGCAAC<br>AAGCTCATCGGGACCTTCCGCATGGTGCTGCAGAAGGTGGTAGAG<br>GAGAGCCATGTGGAGGTGACTGACACGCTGATTGATGACAACAAT<br>GCTATCATCAAGACCAGCCTGTGCGTGGAGGTCCGGTATCAGGCC<br>ACTGACGGCACAGTGGGCTCCTGGGACGATGGGGACTTCCTGGGA<br>GATGAGTCTCTTCAAGAGGAAGAGAAGGACAGCCAAGAGACGGAT<br>GGACTGCTCCCAGGCTCCCGGCCCAGCTCCCGGCCCCCAGGAGAG<br>AAGAGCTTCCGGAGAGCCGGGAGGAGCGTGTTCTCCGCCATGAAG<br>CTCGGCAAAACAGGTCTCACAAGGAGGAGCCCCAAAGACCAGAT<br>GAACCGGCGGTGCTGGAGATGGAAGACCTTGACCATCTGGCCATT<br>CGGCTAGGAGATGGACTGGATCCCGACTCGGTGTCTCTAGCCTCA<br>GTCACAGCTCTCACCACTAATGTCTCCAACAAGCGATCTAAGCCA<br>GACATTAAGATGGAGCCAAGTGCTGGGCGGCCCATGGATTACCAG<br>GTCAGCATCACGGTGATCGAGGCCCGGCAGCTGGTGGGCTTGAAC<br>ATGGACCCTGTGGTGTGCGTGGAGGTGGGTGACGACAAGAAGTAC<br>ACATCCATGAAGGAGTCCACTAACTGCCCCTATTAGAACGAGTAG<br>TTCGTCTTCGACTTCCATGTCTCTCCGGATGTCATGTTTGACAAG<br>ATCATCAAGATTTCGGTGATTCACTCCAAGAACCTGCTGCGCAGT<br>GGCACCCTGGTGGGCTCCTTCAAAATGGACGTGGGGAACCGTGTAC<br>TCGCAGCCAGAGCACCAGTTCCATCACAAGTGGGCCATCCTGTCT<br>GACCCCGATGACATCTCCTGGGGCTGAAGGGCTACGTGAAGTGT<br>GACGTTGCCGTGGTGGGCAAAGGGGACAACATCAAGACGCCCCAC<br>AAGGCCAATGAGACCGACGAAGATGACATTGAGGGGAACTTGCTG<br>CTCCCCGAGGGGTGCCCCCCGAACGCCAGTGGGCCCGGTTCTAT<br>GTGAAAATTTACCGAGCAGAGGGGCTGCCCCGTATGAACACAAGC<br>CTCATGGCCAATGTAAAGAAGGCTTTCATCGGTGAAAACAAGGAC<br>CTCGTGGACCCCTACGTGCAAGTCTTCTTTGCTGGCCAGAAGGGC<br>AAGACTTCAGTGCAGAAGAGCAGCTATGAGCCCCTGTGGAATGAG<br>CAGGTCGTCTTTACAGACCTCTTCCCCCCACTCTGCAAACGCATG<br>AAGGTGCAGATCCGAGACTCGGACAAGGTCAACGACGTGGCCATC<br>GGCACCCACTTCATTGAGCTGCGCAAGATTTCTAATGAGGGAGAC<br>AAAGGCTTCCTGCCCACACTGGGCCCAGCCTGGGTGAACATGTAC<br>GGCTCCACACGTAACTACACGCTGCTGGATGAGCATCAGGACCTG<br>AACGAGGGCCTGGGGGAGGGTGTGTCCTTCCGGGCCCGGCTCCTG<br>CTGGGCCTGGCTGTGGAGATCGTAGACACCTCCAACCCTGAGCTC<br>ACCAGCTCCACAGAGGTGCAGGTGGAGCAGGCCACGCCCATCTCG<br>GAGAGCTGTGCAGGTAAAATGGAAGAATTCTTTCTCTTTGGAGCC<br>TTCCTGGAGGCCTCAATGATCGACCGGAGAAACGGAGACAAGCCC<br>ATCACCTTTGAGGTCACCATAGGCAACTATGGGAACGAAGTTGAT<br>GGCCTGTCCCGGCCCCAGCGGCCTCGGCCCCGGAAGGAGCCGGGG<br>GATGAGGAAGAAGTAGACCTGATTCAGAACGCAAGTGATGACGAG<br>GCCGGTGATGCCGGGGACCTGGCCTCAGTCTCCTCCACTCCACCA<br>ATGCGGCCCCAGGTCACCGACAGGAACTACTTCCATCTGCCCTAC<br>CTGGAGCGAAAGCCCTGCATCTACATCAAGAGCTGGTGGCCGGAC<br>CAGCGCCGCCGCCTCTACAATGCCAACATCATGGACCACATTGCC<br>GACAAGCTGGAAGAAGGCCTGAACGACATACAGGAGATGATCAAA<br>ACGGAGAAGTCCTACCCTGAGCGTCGCCTGCGGGGCGTCCTGGAG<br>GAGCTGAGCTGTGGCTGCTGCCGCTTCCTCTCCCTCGCTGACAAG<br>GACCAGGGCCACTCATCCCGCACCAGGCTTGACCGGGAGCGCCTC<br>AAGTCCTGCATGAGGGAGCTGGAAAACATGGGGCAGCAGGCCAGG<br>ATGCTGCGGGCCCAGGTGAAGCGGCACACGGTGCGGGACAAGCTG<br>AGGCTGTGCCAGAACTTCCTGCAGAAGCTGCGCTTCCTGGCGGAC<br>GAG | 101 |
| SD intron | GTAAGTATCAAGGTTACAAGACAGGTTTAAGGAGACCAATAGAAA<br>CTGGGCTTGTCGAGACAGAGAAGACTCTTGCGTTTCT | 102 |
| AK | GGGATTTTGCCGATTTCGGCCTATTGGTTAAAAAATGAGCTGATT<br>TAACAAAAATTTAACGCGAATTTTAACAAAAT | 103 |
| 3'ITR | AGGAACCCCTAGTGATGGAGTTGGCCACTCCCTCTCTGCGCGCTC<br>GCTCGCTCACTGAGGCCGGGCGACCAAAGGTCGCCCGACGCCCGG<br>GCTTTGCCCGGGCGGCCTCAGTGAGCGAGCGAGCGCGCAGAGAGG<br>GAGTGGCCAA | 104 |

AKhOTOF3

The AKhOTOF3 construct comprises two ITRs (SEQ ID NOS: 97 and 104), an AK recombinogenic sequence (SEQ TD NO: 103), an SA intron sequence (SEQ ID NO: 106), a 3'OTOF coding region (SEQ TD NO: 107), and a bgH polyA sequence (SEQ ID NO: 108). The full-length AKhOTOF3 is represented by SEQ ID NO: 105.

TABLE 2

| | AKhOTOF3 | |
|---|---|---|
| Name | SEQUENCE | SEQ ID NO |
| AKhOTOF3 | TTGGCCACTCCCTCTCTGCGCGCTCGCTCGCTCACTGAGGCCGCC CGGGCAAAGCCCGGGCGTCGGGCGACCTTTGGTCGCCCGGCCTCA GTGAGCGAGCGAGCGCGCAGAGAGGGAGTGGCCAACTCCATCACT AGGGGTTCCTTTGTCGACGCGGCCGCACGCGTGGGATTTTGCCGA TTTCGGCCTATTGGTTAAAAAATGAGCTGATTTAACAAAAATTTA ACGCGAATTTTAACAAAATGATAGGCACCTATTGGTCTTAGTGAG ATCCACTTTGCCTTTCTCTCCACAGCCCCAGCACAGCATTCCCGA CATCTTCATCTGGATGATGAGCAACAACAAGCGTGTCGCCTATGC CCGTGTGCCCTCCAAGGACCTGCTCTTCTCCATCGTGGAGGAGGA GACTGGCAAGGACTGCGCCAAGGTCAAGACGCTCTTCCTTAAGCT GCCAGGGAAGCGGGGCTTCGGCTCGGCAGGCTGGACAGTGCAGGC CAAGGTGGAGCTGTACCTGTGGCTGGGCCTCAGCAAACAGCGCAA GGAGTTCCTGTGCGGCCTGCCCTGTGGCTTCCAGGAGGTCAAGGC AGCCCAGGGCCTGGGCCTGCATGCCTTCCCACCCGTCAGCCTGGT CTACACCAAGAAGCAGGCGTTCCAGCTCCGAGCGCACATGTACCA GGCCCGCAGCCTCTTTGCCGCCGACAGCAGCGGACTCTCAGACCC CTTTGCCCGCGTCTTCTTCATCAATCAGAGTCAGTGCACAGAGGT GCTGAATGAGACCCTGTGTCCCACCTGGGACCAGATGCTGGTGTT CGACAACCTGGAGCTCTATGGTGAAGCTCATGAGCTGAGGGACGA TCCGCCCATCATTGTCATTGAAATCTATGACCAGGATTCCATGGG CAAAGCTGACTTCATGGGCCGGACCTTCGCCAAACCCCTGGTGAA GATGGCAGACGAGGCGTACTGCCCACCCCGCTTCCCACCTCAGCT CGAGTACTACCAGATCTACCGTGGCAACGCCACAGCTGGAGACCT GCTGGCGGCCTTCGAGCTGCTGCAGATTGGACCAGCAGGGAAGGC TGACCTGCCCCCCATCAATGGCCCGGTGGACGTGGACCGAGGTCC CATCATGCCCGTGCCCATGGGCATCCGGCCCGTGCTCAGCAAGTA CCGAGTGGAGGTGCTGTTCTGGGGCCTACGGGACCTAAAGCGGGT GAACCTGGCCCAGGTGGACCGGCCACGGGTGGACATCGAGTGTGC AGGGAAGGGGGTGCAGTCGTCCCTGATCCACAATTATAAGAAGAA CCCCAACTTCAACACCCTCGTCAAGTGGTTTGAAGTGGACCTCCC AGAGAACGAGCTGCTGCACCCGCCCTTGAACATCCGTGTGGTGGA CTGCCGGGCCTTCGGTCGCTACACACTGGTGGGCTCCCATGCCGT CAGCTCCCTGCGACGCTTCATCTACCGGCCCCCAGACCGCTCGGC CCCCAGCTGGAACACCACGGTCAGGCTTCTCCGGCGCTGCCGTGT GCTGTGCAATGGGGGCTCCTCCTCTCACTCCACAGGGGAGGTTGT GGTGACTATGGAGCCAGAGGTACCCATCAAGAAACTGGAGACCAT GGTGAAGCTGGACGCGACTTCTGAAGCTGTTGTCAAGGTGGATGT GGCTGAGGAGGAGAAGGAGAAGAAGAAGAAGAAGAAGGGCACTGC GGAGGAGCCAGAGGAGGAGGAGCCAGACGAGAGCATGCTGGACTG GTGGTCCAAGTACTTTGCCTCCATTGACACCATGAAGGAGCAACT TCGACAACAAGAGCCCTCTGGAATTGACTTGGAGGAGAAGGAGGA AGTGGACAATACCGAGGGCCTGAAGGGGTCAATGAAGGGCAAGGA GAAGGCAAGGGCTGCCAAAGAGGAGAAGAAGAAGAAAACTCAGAG CTCTGGCTCTGGCCAGGGGTCCGAGGCCCCCGAGAAGAAGAAACC CAAGATTGATGAGCTTAAGGTATACCCCAAAGAGCTGGAGTCCGA GTTTGATAACTTTGAGGACTGGCTGCACACTTTCAACTTGCTTCG GGGCAAGACCGGGGATGATGAGGATGGCTCCACCGAGGAGGAGCG CATTGTGGGACGCTTCAAGGGCTCCCTCTGCGTGTACAAAGTGCC ACTCCCAGAGGACGTGTCCCGGGAAGCCGGCTACGACTCCACCTA CGGCATGTTCCAGGGCATCCCGAGCAATGACCCCATCAATGTGCT GGTCCGAGTCTATGTGGTCCGGGCCACGGACCTGCACCCTGCTGA CATCAACGGCAAAGCTGACCCCTACATCGCCATCCGGCTAGGCAA GACTGACATCCGCGACAAGGAGAACTAGATCTCCAAGCAGCTCAA CCCTGTCTTTGGGAAGTCCTTTGACATCGAGGCCTCCTTCCCCAT GGAATCCATGCTGACGGTGGCTGTGTATGACTGGGACCTGGTGGG CACTGATGACCTCATTGGGGAAACCAAGATCGACCTGGAGAACCG CTTCTACAGCAAGCACCGCGCCACCTGCGGCATCGCCCAGACCTA CTCCACACATGGCTACAATATCTGGCGGGACCCCATGAAGCCCAG CCAGATCCTGACCCGCCTCTGCAAAGACGGCAAAGTGGACGGCCC CCACTTTGGGCCCCTGGGAGAGTGAAGGTGGCCAACCGCGTCTTT CACTGGGCCCTCTGAGATTGAGGACGAGAACGGTCAGAGGAAGCC CACAGACGAGCATGTGGCGCTGTTGGCCCTGAGGCACTGGGAGGA CATCCCCGCGCAGGCTGCCGCCTGGTGCCAGAGCATGTGGAGAC GAGGCCGCTGCTCAACCCCGACAAGCCGGGCATCGAGCAGGGCCG CCTGGAGCTGTGGGTGGACATGTTCCCCATGGACATGCCAGCCCC TGGGACGCCTCTGGACATCTCACCTCGGAAGCCCAAGAAGTACGA | 105 |

TABLE 2-continued

AKhOTOF3

| Name | SEQUENCE | SEQ ID NO |
|---|---|---|
| | GCTGCGGGTCATCATCTGGAACACAGATGAGGTGGTCTTGGAGGA CGACGACTTCTTCACAGGGGAGAAGTCCAGTGACATCTTCGTGAG GGGGTGGCTGAAGGGCCAGCAGGAGGACAAGCAGGACACAGACGT CCACTACCACTCCCTCACTGGCGAGGGCAACTTCAACTGGCGCTA CCTGTTCCCCTTCGACTACCTGGCGGCGGAGGAGAAGATCGTCAT CTCCAAGAAGGAGTCCATGTTCTCCTGGGACGAGACCGAGTACAA GATCCCCGCGCGGCTCACCCTGCAGATCTGGGATGCGGACCACTT CTCCGCTGACGACTTCCTGGGGGCATCGAGCTGGACCTGAACCG GTTCCCGCGGGGCGCAAAGACAGCCAAGCAGTGCACCATGGAGAT GGCCACCGGGGAGGTGGACGTGCCCCTCGTGTCCATCTTCAAGCA AAAGCGCGTCAAAGGCTGTGGCCCCTCCTGGCCCGCAATGAGAA CGATGAGTTTGAGCTCACGGGCAAGGTGGAGGCTGAGCTGCATTT ACTGACAGCAGAGGAGGCAGAGAAGAACCCAGTGGGCCTGGCCCG CAATGAACCTGACCCCCTAGAGAAACCCAACCGGCCCGACACGGC CTTCGTCTGGTTCCTCAACCCTCTCAAGTCCATCAAGTACCTCAT CTGCACCCGGTACAAGTGGCTCATCATCAAGATCGTGCTGGCGCT GTTGGGGCTGCTCATGTTGGGGCTCTTCCTCTACAGCCTCCCTGG CTACATGGTCAAAAAGCTCCTTGGGGCATGAACTAGTGCTGATCA GCCTCGACTGTGCCTTCTAGTTGCCAGCCATCTGTTGTTTGCCCC TCCCCCGTGCCTTCCTTGACCCTGGAAGGTGCCACTCCCACTGTC CTTTCCTAATAAAATGAGGAAATTGCATCGCATTGTCTGAGTAGG TGTCATTCTATTCTGGGGGGTGGGTGGGCAGGACAGCAAGGGG GAGGATTGGGAAGACAATAGCAGGCATGCTGGGGATGCGGTGGGC TCTATGGAAGCTTGAATTCAGCTGACGTGCCTCGGACCGCCTAGG AGGAACCCCTAGTGATGGAGTTGGCCACTCCCTCTCTGCGCGCTC GCTCGCTCACTGAGGCCGGGCGACCAAAGGTCGCCCGACGCCCGG GCTTTGCCCGGGCGGCCTCAGTGAGCGAGCGAGCGCGCAGAGAGG GAGTGGCCAA | |
| 5'ITR | TTGGCCACTCCCTCTCTGCGCGCTCGCTCGCTCACTGAGGCCGCC CGGGCAAAGCCCGGGCGTCGGGCGACCTTTGGTCGCCCGGCCTCA GTGAGCGAGCGAGCGCGCAGAGAGGGAGTGGCCAACTCCATCACT AGGGGTTCCT | 97 |
| AK | GGGATTTTGCCGATTTCGGCCTATTGGTTAAAAAATGAGCTGATT TAACAAAAATTTAACGCGAATTTTAACAAAAT | 103 |
| SA intron | GATAGGCACCTATTGGTCTTACTGACATCCACTTTGCCTTTCTCT CCACAG | 106 |
| 3'OTOF | CCCGAGCACAGCATTCCCGAGATCTTCATCTGGATGATGAGCAAC AACAAGCGTGTCGCCTATGCCCGTGTGCCCTCCAAGGACCTGCTC TTCTCCATCGTGGAGGAGGAGACTGGCAAGGACTGCGCCAAGGTC AAGACGCTCTTCCTTAAGCTGCCAGGGAAGCGGGGCTTCGGCTCG GCAGGCTGGACAGTGCAGGCCAAGGTGGAGCTGTACCTGTGGCTG GGCCTCAGCAAACAGCGCAAGGAGTTCCTGTGCGGCCTGCCCTGT GGCTTCCAGGAGGTCAAGGCAGCCCAGGGCCTGGGCCTGCATGCC TTCCCACCCGTCAGCCTGGTCTACACCAAGAAGCAGGCGTTCCAG CTCCGAGCGCACATGTACCAGGCCCGCAGCCTCTTTGCCGCCGAC AGCAGCGGACTCTCAGACCCCTTTGCCCGCGTCTTCTTCATCAAT CAGAGTCAGTGCACAGAGGTGCTGAATGAGACCCTGTGTCCCACC TGGGACCAGATGCTGGTGTTCGACAACCTGGAGCTCTATGGTGAA GCTCATGAGCTGAGGGACGATCCGCCCATCATTGTCATTGAAATC TATGACCAGGATTCCATGGGCAAAGCTGACTTCATGGGCCGGACC TTCGCCAAACCCCTGGTGAAGATGGCAGACGAGGCGTACTGCCCA CCCCGCTTCCCACCTCAGCTCGAGTACTACCAGATCTACCGTGGC AACGCCACAGCTGGAGACCTGCTGGCCGGCCTTCGAGCTGCTGCAG ATTGGACCAGCAGGGAAGGCTGACCTGCCCCCCATCAATGGCCCG GTGGACGTGGACCGAGGTCCCATCATGCCCGTGCCCATGGGCATC CGGCCCGTGCTCAGCAAGTACCGAGTGGAGGTGCTGTTCTGGGGC CTACGGGACCTAAAGCGGGTGAACCTGGCCCAGGTGGACCGGCCA CGGGTGGACATCGAGTGTGCAGGGAAGGGGGTGCAGTCGTCCCTG ATCCACAATTATAAGAAGAACCCCAACTTCAACACCCTCGTCAAG TGGTTTGAAGTGGACCTCCCAGAGAACGAGCTGCTGCACCCGCCC TTGAACATCCGTGTGGTGGACTGCCGGGCCTTCGGTCGCTACACA CTGGTGGGCTCCCATGCCGTCAGCTCCCTGCGACGCTTCATCTAC CGGCCCCCAGACCGCTCGGCCCCCAGCTGGAACACCACGGTCAGG CTTCTCCGGCGCTGCCGTGTGCTGTGCAATGGGGGCTCCTCCTCT CACTCCACAGGGGAGGTTGTGGTGACTATGGAGCCAGAGGTACCC ATCAAGAAACTGGAGACCATGGTGAAGCTGGACGCGACTTCTGAA GCTGTTGTCAAGGTGGATGTGGCTGAGGAGGAGAAGGAGAAGAAG AAGAAGAAGAAGGGCACTGCGGAGGAGCCAGAGGAGGAGGAGCCA GACGAGAGCATGCTGGACTGGTGGTCCAAGTACTTTGCCTCCATT GACACCATGAAGGAGCAACTTGACAACAAGAGCCCTCTGGAATT GACTTGGAGGAGAAGGAGGAAGTGGACAATACCGAGGGCCTGAAG | 107 |

TABLE 2-continued

AKhOTOF3

| Name | SEQUENCE | SEQ ID NO |
|---|---|---|
| | GGGTCAATGAAGGGCAAGGAGAAGGCAAGGGCTGCCAAAGAGGAG<br>AAGAAGAAGAAAACTCAGAGCTCTGGCTCTGGCCAGGGGTCCGAG<br>GCCCCCGAGAAGAAGAAACCCAAGATTGATGAGCTTAAGGTATAC<br>CCCAAAGAGCTGGAGTCCGAGTTTGATAACTTTGAGGACTGGCTG<br>CACACTTTCAACTTGCTTCGGGGCAAGACCGGGGATGATGAGGAT<br>GGCTCCACCGAGGAGGAGCGCATTGTGGGACGCTTCAAGGGCTCC<br>CTCTGCGTGTACAAAGTGCCACTCCCAGAGGACGTGTCCCGGGAA<br>GCCGGCTACGACTCCACCTACGGCATGTTCCAGGGCATCCGAGC<br>AATGACCCCATCAATGCTGGTCCGAGTCTATGTGGTCCGGGCC<br>ACGGACCTGCACCCTGCTGACATCAACGGCAAAGCTGACCCCTAC<br>ATCGCCATCCGGCTAGGCAAGACTGACATCCGCGACAAGGAGAAC<br>TACATCTCCAAGCAGCTCAACCCTGTCTTTGGGAAGTCCTTTGAC<br>ATCGAGGCCTCCTTCCCCATGGAATCCATGCTGACGGTGGCTGTG<br>TATGACTGGGACCTGGTGGGCACTGATGACCTCATTGGGGAAACC<br>AAGATCGACCTGGAGAACCGCTTCTACAGCAAGCACCGCGCCACC<br>TGCGGCATCGCCCAGACCTACTCCACACATGGCTACAATATCTGG<br>CGGGACCCCATGAAGCCCAGCCAGATCCTGACCCGCCTCTGCAAA<br>GACGGCAAAGTGGACGCCCCCACTTTGGGCCCCTGGGAGAGTG<br>AAGGTGGCCAACCGCGTCTTCACTGGGCCCTCTGAGATTGAGGAC<br>GAGAACGGTCAGAGGAAGCCCACAGAGAGCATGTGGCGCTGTTG<br>GCCCTGAGGCACTGGGAGGACATCCCCCGCGCAGGCTGCCGCCTG<br>GTGCCAGAGCATGTGGAGACGAGGCCGCTGCTCAACCCCGACAAG<br>CCGGGCATCGAGCAGGGCCGCCTGGAGCTGTGGGTGGACATGTTC<br>CCCATGGACATGCCAGCCCCTGGGACGCCTCTGGACATCTCACCT<br>CGGAAGCCCAAGAAGTACGAGCTGCGGGTCATCATCTGGAACACA<br>GATGAGGTGGTCTTGGAGGACGACGACTTCTTCACAGGGGAGAAG<br>TCCAGTGACATCTTCGTGAGGGGTGGCTGAAGGGCCAGCAGGAG<br>GACAAGCAGGACACAGACGTCCACTAGCACTCCCTCACTGGCGAG<br>GGCAACTTCAACTGGCGCTACCTGTTCCCCTTCGACTACCTGGCG<br>GCGGAGGAGAAGATCGTCATCTCCAAGAAGGAGTCCATGTTCTCC<br>TGGGACGAGACCGAGTACAAGATCCCCGCGCGGCTCACCCTGCAG<br>ATCTGGGATGCGGACCACTTCTCCGCTGACGACTTCCTGGGGGCC<br>ATCGAGCTGGACCTGAACCGGTTCCCGCGGGGCGCAAAGACAGCC<br>AAGCAGTGCACCATGGAGATGGCCACCGGGGAGGTGGACGTGCCC<br>CTCGTGTCCATCTTCAAGCAAAAGCGCGTCAAAGGCTGGTGGCCC<br>CTCCTGGCCCGCAATGAGAACGATGAGTTTGAGCTCACGGGCAAG<br>GTGGAGGCTGAGCTGCATTTACTGACAGCAGAGGAGGCAGAAG<br>AACCCAGTGGGCCTGGCCCGCAATGAACCTGACCCCCTAGAGAAA<br>CCCAACCGGCCCGACACGGCCTTCGTCTGGTTCCTCAACCCTCTC<br>AAGTCCATCAAGTACCTCATCTGCACCCGGTACAAGTGGCTCATC<br>ATCAAGATCGTGCTGGCGCTGTTGGGGCTGCTCATGTTGGGGCTC<br>TTCCTCTACAGCCTCCCTGGCTACATGGTCAAAAAGCTCCTTGGG<br>GCA | |
| bGHpA | CTGTGCCTTCTAGTTGCCAGCCATCTGTTGTTTGCCCCTCCCCCG<br>TGCCTTCCTTGACCCTGGAAGGTGCCACTCCCACTGTCCTTTCCT<br>AATAAAATGAGGAAATTGCATCGCATTGTCTGAGTAGGTGTCATT<br>CTATTCTGGGGGGTGGGGTGGGGCAGGACAGCAAGGGGGAGGATT<br>GGGAAGACAATAGCAGGCATGCTGGGGATGCGGTGGGCTCTATGG | 108 |
| 3'ITR | AGGAACCCCTAGTGATGGAGTTGGCCACTCCCTCTCTGCGCGCTC<br>GCTCGCTCACTGAGGCCGGGCGACCAAAGGTCGCCCGACGCCCGG<br>GCTTTGCCCGGGCGGCCTCAGTGAGCGAGCGAGCGCGCAGAGAGG<br>GAGTGGCCAA | 104 |

TABLE 3

Anc80L65

| Name | SEQUENCE | SEQ ID NO |
|---|---|---|
| Anc80L65 | MAADGYLPDWLEDNLSEGIREWWDL<br>KPGAPKPKANQQKQDDGRGLVLPGY<br>KYLGPFNGLDKGEPVNAADAAALEH<br>DKAYDQQLKAGDNPYLRYNHADAEF<br>QERLQEDTSFGGNLGRAVFQAKKRV<br>LEPLGLVEEGAKTAPGKKRPVEQSP<br>QEPDSSSGIGKKGQQPARKRLNFGQ<br>TGDSESVPDPQPLGEPPAAPSGVGS<br>NTMAAGGGAPMADNNEGADGVGNAS<br>GNWHCDSTWLGDRVITTSTRTWALP<br>TYNNHLYKQISSQSGGSTNDNTYFG<br>YSTPWGYFDFNRFHCHFSPRDWQRL<br>INNNWGFRPKKLNFKLFNIQVKEVT<br>TNDGTTTIANNLTSTVQVFTDSEYQ<br>LPYVLGSAHQGCLPPFPADVFMIPQ<br>YGYLTLNNGSQAVGRSSFYCLEYFP<br>SQMLRTGNNFQFSYTFEDVPFHSSY<br>AHSQSLDRLMNPLIDQYLYYLSRTQ<br>TTSGTAGNRTLQFSQAGPSSMANQA<br>KNWLPGPCYRQQRVSKTTNQNNNSN | 109 |

TABLE 3-continued

Anc80L65

| Name | SEQUENCE | SEQ ID NO |
|---|---|---|
| | FAWTGATKYHLNGRDSLVNPGPAMA<br>THKDDEDKFFPMSGVLIFGKQGAGN<br>SNVDLDNVMITNEEEIKTTNPVATE<br>EYGTVATNLQSANTAPATGTVNSQG<br>ALPGMVWQDRDVYLQGPIWAKIPHT<br>DGHFHPSPLMGGFGLKHPPPQILIK<br>NTPVPANPPTTFSPAKFASFITQYS<br>TGQVSVEIEWELQKENSKRWNPEIQ<br>YTSNYNKSTNVDFAVDTNGVYSEPR<br>PIGTRYLTRNL* | |

Other Embodiments

It is to be understood that the words which have been used are words of description rather than limitation, and that changes may be made within the purview of the appended claims without departing from the true scope and spirit of the disclosure in its broader aspects.

While the present disclosure has been described at some length and with some particularity with respect to the several described embodiments, it is not intended that it should be limited to any such particulars or embodiments or any particular embodiment, but it is to be construed with references to the appended claims so as to provide the broadest possible interpretation of such claims in view of the prior art and, therefore, to effectively encompass the intended scope of the disclosure.

It is to be understood that while the disclosure has been described in conjunction with the detailed description thereof, the foregoing description is intended to illustrate and not limit the scope of the disclosure, which is defined by the scope of the appended claims. Other aspects, advantages, and modifications are within the scope of the following claims.

All publications, patent applications, patents, and other references mentioned herein are incorporated by reference in their entirety. In case of conflict, the present specification, including definitions, will control. In addition, section headings, the materials, methods, and examples are illustrative only and not intended to be limiting.

SEQUENCE LISTING (110 sequences)

SEQ ID NO: 1 - protein, 1997 aa, Homo sapiens
MALLIHLKTVSELRGRGDRIAKVTFRGQSFYSRVLENCEDVADFDETFRWPVASSIDRNEMLEIQVFNYSKVFSNKLIGTFRMVLQKVVEESHVEVTDTLIDDNNAIIKTSLCVEVRYQATDGTVGSWDDGDFLGDESLQEEEKDSQETDGLLPGSRPSSRPPGEKSFRRAGRSVFSAMKLGKNRSHKEEPQRPDEPAVLEMEDLDHLAIRLGDGLDPDSVSLASVTALTTNVSNKRSKPDIKMEPSAGRPMDYQVSITVIEARQLVGLNMDPVVCVEVGDDKKYTSMKESTNCPYYNEYFVFDFHVSPDVMFDKIIKISVIHSKNLLRSGTLVGSFKMDVGTVYSQPEHQFHHKWAILSDPDDISSGLKGYVKCDVAVVGKGDNIKTPHKANETDEDDIEGNLLLPEGVPPERQWARFYVKIYRAEGLPRMNTSLMANVKKAFIGENKDLVDPYVQVFFAGQKGKTSVQKSSYEPLWNEQVVFTDLFPPLCKRMKVQIRDSDKVNDVAIGTHFIDLRKISNDGDKGFLPTLGPAWVNMYGSTRNYTLLDEHQDLNEGLGEGVSFRARLLLGLAVEIVDTSNPELTSSTEVQVEQATPISESCAGKMEEFFLFGAFLEASMIDRRNGDKPITFEVTIGNYGNEVDGLSRPQRPRPRKEPGDEEEVDLIQNASDDEAGDAGDLASVSSTPPMRPQVTDRNYFHLPYLERKPCIYIKSWWPDQRRRLYNANIMDHIADKLEEGLNDIQEMIKTEKSYPERRLRGVLEELSCGCCRFLSLADKDQGHSSRTRLDRERLKSCMRELENMGQQARMLRAQVKRHTVRDKLRLCQNFLQKLRFLADEPQHSIPDIFIWMMSNNKRVAYARVPSKDLLFSIVEEETGKDCAKVKTLFLKLPGKRGFGSAGWTVQAKVELYLWLGLSKQRKEFLCGLPCGFQEVKAAQGLGLHAFPPVSLVYTKKQAFQLRAHMYQARSLFAADSSGLSDPFARVFFINQSQCTEVLNETLCPTWDQMLVFDNLELYGEAHELRDDPPIIVIEIYDQDSMGKADFMGRTFAKPLVKMADEAYCPPRFPPQLEYYQIYRGNATAGDLLAAFELLQIGPAGKADLPPINGPVDVDRGPIMPVPMGIRPVLSKYRVEVLFWGLRDLKRVNLAQVDRPRVDIECAGKGVQSSLIHNYKKNPNFNTLVKWFEVDLPENELLHPPLNIRVVDCRAFGRYTLVGSHAVSSLRRFIYRPPDRSAPSWNTTVRLLRRCRVLCNGGSSSHSTGEVVVTMEPEVPIKKLETMVKLDATSEAVVKVDVAEEEKEKKKKKKGTAEEPEEEEPDESMLDWWSKYFASIDTMKEQLRQQEPSGIDLEEKEEVDNTEGLKGSMKGKEKARAAKEEKKKKTQSSGSGQGSEAPEKKKPKIDELKVYPKELESEFDNFEDWLHTFNLLRGKTGDDEDGSTEEERIVGRFKGSLCVYKVPLPEDVSREAGYDSTYGMFQGIPSNDPINVLVRVYVVRATDLHPADINGKADPYIAIRLGKTDIRDKENYISKQLNPVFGKSFDIEASFPMESMLTVAVYDWDLVGTDDLIGETKIDLENRFYSKHRATCGIAQTYSTHGYNIWRDPMKPSQILTRLCKDGKVDGPHFGPPGRVKVANRVFTGPSEIEDENGQRKPTDEHVALLALRHWEDIPRAGCRLVPEHVETRPLLNPDKPGIEQGRLELWVDMFPMDMPAPGTPLDISPRKPKKYELRVIIWNTDEVVLEDDDFFTGEKSSDIFVRGWLKGQQEDKQDTDVHYHSLTGEGNFNWRYLFPFDYLAAEEKIVISKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTSFIWFLNPLKSARYFLWHTYRWLLLKLLLLLLLLLLLALFLYSVPGYLVKKILGA

SEQ ID NO: 2 - protein, 1230 aa, Homo sapiens
MIKTEKSYPERRLRGVLEELSCGCCRFLSLADKDQGHSSRTRLDRERLKSCMRELENMGQQARMLRAQVKRHTVRDKLRLCQNFLQKLRFLADEPQHSIPDIFIWMMSNNKRVAYARVPSKDLLFSIVEEETGKDCAKVKTLFLKLPGKRGFGSAGWTVQAKVELYLWLGLSKQRKEFLCGLPCGFQEVKAAQGLGLHAFPPVSLVYTKKQAFQLRAHMYQARSLFAADSSGLSDPFARVFFINQSQCTEVLNETLCPTWDQMLVFDNLELYGEAHELRDDPPIIVIEIYDQDSMGKADFMGRTFAKPLVKMADEAYCPPRFPPQLEYYQIYRGNATAGDLLAAFELLQIGPAGKADLPPINGPVDVDRGPIMPVPMGIRPVLSKYRVEVLFWGLRDLKRVNLAQVDRPRVDIECAGKGVQSSLIHNYKKNPNFNTLVKWFEVDLPENELLHPPLNIRVVDCRAFGRYTLVGSHAVSSLRRFIYRPPDRSAPSWNTTGEVVVTMEPEVPIKKLETMVKLDATSEAVVKVDVAEEEKEKKKKKKGTAEEPEEEEPDESMLDWWSKYFASIDTMKEQLRQQEPSGIDLEEKEEVDNTEGLKGSMKGKEKARAAKEEKKKKTQSSGSGQGSEAPEKKKPKIDELKVYPKELESEFDNFEDWLHTFNLLRGKTGDDEDGSTEEERIVGRFKGSLCVYKVPLPEDVSREAGYDSTYGMFQGIPSNDPINVLVRVYVVRATDLHPADINGKADPYIAIRLGKTDIRDKENYISKQLNPVFGKSFDIEASFPMESMLTVAVYDWDLVGTDDLIGETKIDLENRFYSKHRATCGIAQTYSTHGYNIWRDPMKPSQILTRLCKDGKVDGPHFGPPGRVKVANRVFTGPSEIEDENGQRKPTDEHVALLALRHWEDIPRAGCRLVPEHVETRPLLNPDKPGIEQGRLELWVDMFPMDMPAPGTPLDISPRKPKKYELRVIIWNTDEVVLEDDDFFTGEKSSDIFVRGWLKGQQEDKQDTDVHYHSLTGEGNFNWRYLFPFDYLAAEEKIVISKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTAFVWFLNPLKSIKYLICTRYKWLIIKIVLALLGLLMLGLFLYSLPGYMVKKLLGA

SEQ ID NO: 3 - protein, 1307 aa, Homo sapiens
MMTDTQDGPSESSQIMRSLTPLINREEAFGEAGEAGLWPSITHTPDSQEEGLNDIQEMIKTEKSYPERRLRGVLEELSCGCCRFLSLADKDQGHSSRTRLDRERLKSCMRELENMGQQARMLRAQVKRHTVRDKLRLCQNFLQKLRFLADEPQHSIPDIFIWMMSNNKRVAYARVPSKDLLFSIVEEETGKDCAKVKTLFLKLPGKRGFGSAGWTVQAKVELYLWLGLSKQRKEFLCGLPCGFQEVKAAQGLGLHAFPPVSLVYTKKQAFQLRAHMYQARSLFAADSSGLSDPFARVFFINQSQCTEVLNETLCPTWDQMLVFDNLELYGEAHELRDDPPIIVIEIYDQDSMGKADFMGRTFAKPLVKMADEAYCPPRFPPQLEYYQIYRGNATAGDLLAAFELLQIGPAGKADLPPINGPVDVDRGPIMPVPMGIRPVLSKYRVEVLFWGLRDLKRVNLAQVDRPRVDIECAGKGVQSSLIHNYKKNPNFNTLVKWFEVDLPENELLHPPLNIRVVDCRAFGRYTLVGSHAVSSLRRFIYRPPDRSAPSWNTTVRLLRRCRVLCNGGSSSHSTGEVVVTMEPEVPIKKLETMVKLDATSEAVVKVDVAEEEKEKKKKKKGTAEEPEEEEPDESMLDWWSKYFASIDTMKEQLRQQEPSGIDLEEKEEVDNTEGLKGSMKGKEKARAAKEEKKKKTQSSGSGQGSEAPEKKKPKIDELKVYPKELESEFDNFEDWLHTFNLLRGKTGDDEDGSTEEERIVGRFKGSLCVYKVPLPEDVSREAGYDSTYGMFQGIPSNDPINVLVRVYVVRATDLHPADINGKADPYIAIRLGKTDIRDKENYISKQLNPVFGKSFDIEASFPMESMLTVAVYDWDLVGTDDLIGETKIDLENRFYSKHRATCGIAQTYSTHGYNIWRDPMKPSQILTRLCKDGKVDGPHFGPPGRVKVANRVFTGPSEIEDENGQRKPTDEHVALLALRHWEDIPRAGCRLVPEHVETRPLLNPDKPGIEQGRLELWVDMFPMDMPAPGTPLDISPRKPKKYELRVIIWNTDEVVLEDDDFFTGEKSSDIFVRGWLKGQQEDKQDTDVHYHSLTGEGNFNWRYLFPFDYLAAEEKIVISKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTSFIWFLNPLKSARYFLWHTYRWLLLKLLLLLLLLLLLALFLYSVPGYLVKKILGA

SEQ ID NO: 4 - protein, 1230 aa, Homo sapiens
MIKTEKSYPERRLRGVLEELSCGCCRFLSLADKDQGHSSRTRLDRERLKSCMRELENMGQQARMLRAQVKRHTVRDKLRLCQNFLQKLRFLADEPQHSIPDIFIWMMSNNKRVAYARVPSKDLLFSIVEEETGKDCAKVKTLFLKLPGKRGFGSAGWTVQAKVELYLWLGLSKQRKEFLCGLPCGFQEVKAAQGLGLHAFPPVSLVYTKKQAFQLRAHMYQARSLFAADSSGLSDPFARVFFINQSQCTEVLNETLCPTWDQMLVFDNLELYGEAHELRDDPPIIVIEIYDQDSMGKADFMGRTFAKPLVKMADEAYCPPRFPPQLEYYQIYRGNATAGDLLAAFELLQIGPAGKADLPPINGPVDVDRGPIMPVPMGIRPVLSKYRVEVLFWGLRDLKRVNLAQVDRPRVDIECAGKGVQSSLIHNYKKNPNFNTLVKWFEVDLPENELLHPPLNIRVVDCRAFGRYTLVGSHAVSSLRRFIYRPPDRSAPSWNTTGEVVVTMEPEVPIKKLETMVKLDATSEAVVKVDVAEEEKEKKKKKKGTAEEPEEEEPDESMLDWWSKYFASIDTMKEQLRQQEPSGIDLEEKEEVDNTEGLKGSMKGKEKARAAKEEKKKKTQSSGSGQGSEAPEKKKPKIDELKVYPKELESEFDNFEDWLHTFNLLRGKTGDDEDGSTEEERIVGRFKGSLCVYKVPLPEDVSREAGYDSTYGMFQGIPSNDPINVLVRVYVVRATDLHPADINGKADPYIAIRLGKTDIRDKENYISKQLNPVFGKSFDIEASFPMESMLTVAVYDWDLVGTDDLIGETKIDLENRFYSKHRATCGIAQTYSTHGYNIWRDPMKPSQILTRLCKDGKVDGPHFGPPGRVKVANRVFTGPSEIEDENGQRKPTDEHVALLALRHWEDIPRAGCRLVPEHVETRPLLNPDKPGIEQGRLELWVDMFPMDMPAPGTPLDISPRKPKKYELRVIIWNTDEVVLEDDDFFTGEKSSDIFVRGWLKGQQEDKQDTDVHYHSLTGEGNFNWRYLFPFDYLAAEEKIVISKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTSFIWFLNPLKSARYFLWHTYRWLLLKLLLLLLLLLLLALFLYSVPGYLVKKILGA

SEQ ID NO: 5 - protein, 1997 aa, Homo sapiens
MALLIHLKTVSELRGRGDRIAKVTFRGQSFYSRVLENCEDVADFDETFRWPVASSIDRNEMLEIQVFNYSKVFSNKLIGTFRMVLQKVVEESHVEVTDTLIDDNNAIIKTSLCVEVRYQATDGTVGSWDDGDFLGDESLQEEEKDSQETDGLLPGSRPSSRPPGEKSFRRAGRSVFSAMKLGKNRSHKEEPQRPDEPAVLEMEDLDHLAIRLGDGLDPDSVSLASVTALTTNVSNKRSKPDIKMEPSAGRPMDYQVSITVIEARQLVGLNMDPVVCVEVGDDKKYTSMKESTNCPYYNEYFVFDFHVSPDVMFDKIIKISVIHSKNLLRSGTLVGSFKMDVGTVYSQPEHQFHHKWAILSDPDDISSGLKGYVKCDVAVVGKGDNIKTPHKANETDEDDIEGNLLLPEGVPPERQWARFYVKIYRAEGLPRMNTSLMANVKKAFIGENKDLVDPYVQVFFAGQKGKTSVQKSSYEPLWNEQVVFTDLFPPLCKRMKVQIRDSDKVNDVAIGTHFIDLRKISNDGDKGFLPTLGPAWVNMYGSTRNYTLLDEHQDLNEGLGEGVSFRARLLLGLAVEIVDTSNPELTSSTEVQVEQATPISESCAGKMEEFFLFGAFLEASMIDRRNGDKPITFEVTIGNYGNEVDGLSRPQRPRPRKEPGDEEEVDLIQNASDDEAGDAGDLASVSSTPPMRPQVTDRNYFHLPYLERKPCIYIKSWWPDQRRRLYNANIMDHIADKLEEGLNDIQEMIKTEKSYPERRLRGVLEELSCGCCRFLSLADKDQGHSSRTRLDRERLKSCMRELENMGQQARMLRAQVKRHTVRDKLRLCQNFLQKLRFLADEPQHSIPDIFIWMMSNNKRVAYARVPSKDLLFSIVEEETGKDCAKVKTLFLKLPGKRGFGSAGWTVQAKVELYLWLGLSKQRKEFLCGLPCGFQEVKAAQGLGLHAFPPVSLVYTKKQAFQLRAHMYQARSLFAADSSGLSDPFARVFFINQSQCTEVLNETLCPTWDQMLVFDNLELYGEAHELRDDPPIIVIEIYDQDSMGKADFMGRTFAKPLVKMADEAYCPPRFPPQLEYYQIYRGNATAGDLLAAFELLQIGPAGKADLPPINGPVDVDRGPIMPVPMGIRPVLSKYRVEVLFWGLRDLKRVNLAQVDRPRVDIECAGKGVQSSLIHNYKKNPNFNTLVKWFEVDLPENELLHPPLNIRVVDCRAFGRYTLVGSHAVSSLRRFIYRPPDRSAPSWNTTVRLLRRCRVLCNGGSSSHSTGEVVVTMEPEVPIKKLETMVKLDATSEAVVKVDVAEEEKEKKKKKKGTAEEPEEEEPDESMLDWWSKYFASIDTMKEQLRQQEPSGIDLEEKEEVDNTEGLKGSMKGKEKARAAKEEKKKKTQSSGSGQGSEAPEKKKPKIDELKVYPKELESEFDNFEDWLHTFNLLRGKTGDDEDGSTEEERIVGRFKGSLCVYKVPLPEDVSREAGYDSTYGMFQGIPSNDPINVLVRVYVVRATDLHPADINGKADPYIAIRLGKTDIRDKENYISKQLNPVFGKSFDIEASFPMESMLTVAVYDWDLVGTDDLIGETKIDLENRFYSKHRATCGIAQTYSTHGYNIWRDPMKPSQILTRLCKDGKVDGPHFGPPGRVKVANRVFTGPSEIEDENGQRKPTDEHVALLALRHWEDIPRAGCRLVPEHVETRPLLNPDKPGIEQGRLELWVDMFPMDMPAPGTPLDISPRKPKKYELRVIIWNTDEVVLEDDDFFTGEKSSDIFVRGWLKGQQEDKQDTDVHYHSLTGEGNFNWRYLFPFDYLAAEEKIVISKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTAFVWFLNPLKSIKYLICTRYKWLIIKIVLALLGLLMLGLFLYSLPGYMVKKLLGA

SEQ ID NO: 6 - DNA, 4970 bp, Homo sapiens
  source 1..4970: mol_type = genomic DNA
ccgtgagttctgcccaggccctgtgagctcaccagagccacagactcacagcccagaggtggcttcttccttcaggaactgaagaacccccatgaacaccaacatctccaggttctgagaacagaacctgggaaattgatgacttcctcatgatgaccgatactcaggatggccctagcgagagctcccagatcatgaggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacccgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacgggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacgagcttcatctggttcctgaaccctctcaagtcggctcgctacttcttgtggcacacgtatcgctggctgctcctcaaactgttgctgctcctgctgctgctcctcctcctcgccctgttcctctactctgtgcctggctacctggtcaagaaaatcctcggggcctgagcccagtggcctcctggccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccacttttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctttcttgccccacctggctgaggcgccacccttcttcaggcccaggctccagaggaagactcctgaaaccctccccaggttttccaagtacaggattgaagctttagtgaaattaaccaaggaccatgggtcagtgcccagggctttaaaaagaatgaacgagcaaaaggtatccccgccgtgacccctgcagatagcaccggtatttgatccgcagcaggggccagaccctgcccacaagtcccagcgcggatgtttctgccactgctgggctccacttggctcctctcacttcccagggggtcgcctgtcctgcctgtgggtttccatggcttcccagagttccctctgccccagccagcgcctccaggcccagctgaggagctgtgagaagcagcagaggggactccccatcccgggcacaccctgtcttcccacccctgcccccttgcccttccagccctttcagctgcaggtgggagctggcccgtcaagtgctgcccctgcctgtgtctgggtttctgttggctgtttttcttttcttggagtggtgatttttctctaaataaaagaagtcaagcactgaaaaaaaaaaaaaaaa

SEQ ID NO: 7 - DNA, 7171 bp, Homo sapiens
  source 1..7171: mol_type = genomic DNA
atcggaggggggtcgggaggaggaggaggaggcagcggcagagaagagagaggcgtgtgagccgtgctccaccggctagctccttcccgctgctcctgcctggcagtgccaggcagcccacaccagcatggccttgctcatccacctcaagacagtctcggagctgcggggcaggggcgaccggatcgccaaagtgactttccgagggcaatccttctactctcgggtcctggagaactgtgaggatgtggctgactttgatgagacatttcggtggccggtggccagcagcatcgacagaaatgagatgctggagattcaggttttcaactacagcaaagtcttcagcaacaagctcatcgggaccttccgcatggtgctgcagaaggtggtagaggagagccatgtggaggtgactgacacgctgattgatgacaacaatgctatcatcaagaccagcctgtgcgtggaggtccggtatcaggccactgacggcacagtgggctcctgggacgatggggacttcctgggagatgagtctcttcaagaggaagagaaggacagccaagagacggatggactgctcccaggctcccggcccagctcccggcccccaggagagaagagcttccggagagccgggaggagcgtgttctccgccatgaagctcggcaaaaaccggtctcacaaggaggagccccaaagaccagatgaaccggcggtgctggagatggaagaccttgaccatctggccattcggctaggagatggactggatcccgactcggtgtctctagcctcagtcacagctctcaccactaatgtctccaacaagcgatctaagccagacattaagatggagccaagtgctgggcggcccatggattaccaggtcagcatcacggtgatcgaggcccggcagctggtgggcttgaacatggaccctgtggtgtgcgtggaggtgggtgacgacaagaagtacacatccatgaaggagtccactaactgcccctattacaacgagtacttcgtcttcgacttccatgtctctccggatgtcatgtttgacaagatcatcaagatttcggtgattcactccaagaacctgctgcgcagtggcaccctggtgggctccttcaaaatggacgtgggaaccgtgtactcgcagccagagcaccagttccatcacaagtgggccatcctgtctgaccccgatgacatctcctcggggctgaagggctacgtgaagtgtgacgttgccgtggtgggcaaaggggacaacatcaagacgccccacaaggccaatgagaccgacgaagatgacattgaggggaacttgctgctccccgagggggtgccccccgaacgccagtgggcccggttctatgtgaaaatttaccgagcagaggggctgccccgtatgaacacaagcctcatggccaatgtaaagaaggctttcatcggtgaaaacaaggacctcgtggacccctacgtgcaagtcttctttgctggccagaagggcaagacttcagtgcagaagagcagctatgagcccctgtggaatgagcaggtcgtctttacagacctcttccccccactctgcaaacgcatgaaggtgcagatccgagactcggacaaggtcaacgacgtggccatcggcacccacttcattgacctgcgcaagatttctaatgacggagacaaaggcttcctgcccacactgggcccagcctgggtgaacatgtacggctccacacgtaactacacgctgctggatgagcatcaggacctgaacgagggcctgggggagggtgtgtccttccgggcccggctcctgctgggcctggctgtggagatcgtagacacctccaaccctgagctcaccagctccacagaggtgcaggtggagcaggccacgcccatctcggagagctgtgcaggtaaaatggaagaattctttctctttggagccttcctggaggcctcaatgatcgaccggagaaacggagacaagcccatcacctttgaggtcaccataggcaactatgggaacgaagttgatggcctgtcccggccccagcggcctcggccccggaaggagccgggggatgaggaagaagtagacctgattcagaacgcaagtgatgacgaggccggtgatgccggggacctggcctcagtctcctccactccaccaatgcggccccaggtcaccgacaggaactacttccatctgccctacctggagcgaaagccctgcatctacatcaagagctggtggccggaccagcgccgccgcctctacaatgccaacatcatggaccacattgccgacaagctggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacggtcaggcttctccggcgctgccgtgtgctgtgcaatgggggctcctcctctcactccacaggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacgagcttcatctggttcctgaaccctctcaagtcggctcgctacttcttgtggcacacgtatcgctggctgctcctcaaactgttgctgctcctgctgctgctcctcctcctcgccctgttcctctactctgtgcctggctacctggtcaagaaaatcctcggggcctgagcccagtggcctcctggccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccactcttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctctcttgccccacctggctgaggcgccacccttcttcaggcccaggctccagaggaagactcctgaaaccctccccaggtcttccaagtacaggattgaagctttagtgaaattaaccaaggaccatgggtcagtgcccagggctttaaaaagaatgaacgagcaaaaggtatccccgccgtgacccctgcagatagcaccggtctttgatccgcagcaggggccagaccctgcccacaagtcccagcgcggctgcttctgccactgctgggctccacttggctcctctcacttcccagggggtcgcctgtcctgcctgtgggtttccatggcttcccagagctccctctgccccagccagcgcctccaggcccagctgaggagctgtgagaagcagcagaggggactccccatcccgggcacaccctgtcctcccacccctgcccccttgcccttccagccctttcagctgcagctgggagctggcccgtcaagtgctgcccctgcctgtgtctgggtttctgttggctgtttttcttttcttgagtggtgatttttctctaaataaaagaagtcaagcactgaaaaaaaaaaaaaaaa

SEQ ID NO: 8 - DNA, 4969 bp, Homo sapiens
  source 1..4969: mol_type = genomic DNA
ccgtgagttctgcccaggccctgtgagctcaccagagccacagactcacagcccagaggtggcttcttccttcaggaactgaagaacccccatgaacaccaacatctccaggttctgagaacagaacctgggaaattgatgacttcctcatgatgaccgatactcaggatggccctagcgagagctcccagatcatgaggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacgggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacgagcttcatctggttcctgaaccctctcaagtcggctcgctacttcttgtggcacacgtatcgctggctgctcctcaaactgttgctgctcctgctgctgctcctcctcctcgccctgttcctctactctgtgcctggctacctggtcaagaaaatcctcggggcctgagcccagtggcctcctggccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccactcttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctctcttgccccacctggctgaggcgccacccttcttcaggcccaggctccagaggaagactcctgaaaccctccccaggtcttccaagtacaggattgaagctttagtgaaattaaccaaggaccatgggtcagtgcccagggctttaaaaagaatgaacgagcaaaaggtatccccgccgtgacccctgcagatagcaccggtctttgatccgcagcaggggccagaccctgcccacaagtcccagcgcggctgcttctgccactgctgggctccacttggctcctctcacttcccagggggtcgcctgtcctgcctgtgggtttccatggcttcccagagctccctctgccccagccagcgcctccaggcccagctgaggagctgtgagaagcagcagaggggactccccatcccgggcacaccctgtcctcccacccctgcccccttgcccttccagccctttcagctgcagctgggagctggcccgtcaagtgctgcccctgcctgtgtctgggtttctgttggctgtttttcttttcttgagtggtgatttttctctaaataaaagaagtcaagcactgaaaaaaaaaaaaaaaa

SEQ ID NO: 9 - DNA, 5123 bp, Homo sapiens
  source 1..5123: mol_type = genomic DNA
ccgtgagttctgcccaggccctgtgagctcaccagagccacagactcacagcccagaggtggcttcttccttcaggaactgaagaacccccatgaacaccaacatctccaggttctgagaacagaacctgggaaattgatgacttcctcatgatgaccgatactcaggatggccctagcgagagctcccagatcatgaggtccctcactcccctgatcaacagggaggaggcatttggggaggctggggaggcggggctgtggcccagcatcacccacactcctgattcacaggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacggtcaggcttctccggcgctgccgtgtgctgtgcaatgggggctcctcctctcactccacaggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacgagcttcatctggttcctgaaccctctcaagtcggctcgctacttcttgtggcacacgtatcgctggctgctcctcaaactgttgctgctcctgctgctgctcctcctcctcgccctgttcctctactctgtgcctggctacctggtcaagaaaatcctcggggcctgagcccagtggcctcctggccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccactcttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctctcttgccccacctggctgaggcgccacccttcttcaggcccaggctccagaggaagactcctgaaaccctccccaggtcttccaagtacaggattgaagctttagtgaaattaaccaaggaccatgggtcagtgcccagggctttaaaaagaatgaacgagcaaaaggtatccccgccgtgacccctgcagatagcaccggtctttgatccgcagcaggggccagaccctgcccacaagtcccagcgcggctgcttctgccactgctgggctccacttggctcctctcacttcccagggggtcgcctgtcctgcctgtgggtttccatggcttcccagagctccctctgccccagccagcgcctccaggcccagctgaggagctgtgagaagcagcagaggggactccccatcccgggcacaccctgtcctcccacccctgcccccttgcccttccagccctttcagctgcagctgggagctggcccgtcaagtgctgcccctgcctgtgtctgggtttctgttggctgtttttcttttcttgagtggtgatttttctctaaataaaagaagtcaagcactgaaaaaaaaaaaaaaaa

SEQ ID NO: 10 - DNA, 4771 bp, Homo sapiens
  source 1..4771: mol_type = genomic DNA
ccgtgagttctgcccaggccctgtgagctcaccagagccacagactcacagcccagaggtggcttcttccttcaggaactgaagaacccccatgaacaccaacatctccaggttctgagaacagaacctgggaaattgatgacttcctcatgatgaccgatactcaggatggccctagcgagagctcccagatcatgaggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacgggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccactcttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctctcttgccccacctggctgaggcgccacccttcttcaggcccaggctccagaggaagactcctgaaaccctccccaggtcttccaagtacaggattgaagctttagtgaaattaaccaaggaccatgggtcagtgcccagggctttaaaaagaatgaacgagcaaaaggtatccccgccgtgacccctgcagatagcaccggtctttgatccgcagcaggggccagaccctgcccacaagtcccagcgcggctgcttctgccactgctgggctccacttggctcctctcacttcccagggggtcgcctgtcctgcctgtgggtttccatggcttcccagagctccctctgccccagccagcgcctccaggcccagctgaggagctgtgagaagcagcagaggggactccccatcccgggcacaccctgtcctcccacccctgcccccttgcccttccagccctttcagctgcagctgggagctggcccgtcaagtgctgcccctgcctgtgtctgggtttctgttggctgtttttcttttcttgagtggtgatttttctctaaataaaagaagtcaagcactgaaaaaaaaaaaaaaaa

SEQ ID NO: 11 - DNA, 6973 bp, Homo sapiens
  source 1..6973: mol_type = genomic DNA
atcggaggggggtcgggaggaggaggaggaggcagcggcagagaagagagaggcgtgtgagccgtgctccaccggctagctccttcccgctgctcctgcctggcagtgccaggcagcccacaccagcatggccttgctcatccacctcaagacagtctcggagctgcggggcaggggcgaccggatcgccaaagtgactttccgagggcaatccttctactctcgggtcctggagaactgtgaggatgtggctgactttgatgagacatttcggtggccggtggccagcagcatcgacagaaatgagatgctggagattcaggttttcaactacagcaaagtcttcagcaacaagctcatcgggaccttccgcatggtgctgcagaaggtggtagaggagagccatgtggaggtgactgacacgctgattgatgacaacaatgctatcatcaagaccagcctgtgcgtggaggtccggtatcaggccactgacggcacagtgggctcctgggacgatggggacttcctgggagatgagtctcttcaagaggaagagaaggacagccaagagacggatggactgctcccaggctcccggcccagctcccggcccccaggagagaagagcttccggagagccgggaggagcgtgttctccgccatgaagctcggcaaaaaccggtctcacaaggaggagccccaaagaccagatgaaccggcggtgctggagatggaagaccttgaccatctggccattcggctaggagatggactggatcccgactcggtgtctctagcctcagtcacagctctcaccactaatgtctccaacaagcgatctaagccagacattaagatggagccaagtgctgggcggcccatggattaccaggtcagcatcacggtgatcgaggcccggcagctggtgggcttgaacatggaccctgtggtgtgcgtggaggtgggtgacgacaagaagtacacatccatgaaggagtccactaactgcccctattacaacgagtacttcgtcttcgacttccatgtctctccggatgtcatgtttgacaagatcatcaagatttcggtgattcactccaagaacctgctgcgcagtggcaccctggtgggctccttcaaaatggacgtgggaaccgtgtactcgcagccagagcaccagttccatcacaagtgggccatcctgtctgaccccgatgacatctcctcggggctgaagggctacgtgaagtgtgacgttgccgtggtgggcaaaggggacaacatcaagacgccccacaaggccaatgagaccgacgaagatgacattgaggggaacttgctgctccccgagggggtgccccccgaacgccagtgggcccggttctatgtgaaaatttaccgagcagaggggctgccccgtatgaacacaagcctcatggccaatgtaaagaaggctttcatcggtgaaaacaaggacctcgtggacccctacgtgcaagtcttctttgctggccagaagggcaagacttcagtgcagaagagcagctatgagcccctgtggaatgagcaggtcgtctttacagacctcttccccccactctgcaaacgcatgaaggtgcagatccgagactcggacaaggtcaacgacgtggccatcggcacccacttcattgacctgcgcaagatttctaatgacggagacaaaggcttcctgcccacactgggcccagcctgggtgaacatgtacggctccacacgtaactacacgctgctggatgagcatcaggacctgaacgagggcctgggggagggtgtgtccttccgggcccggctcctgctgggcctggctgtggagatcgtagacacctccaaccctgagctcaccagctccacagaggtgcaggtggagcaggccacgcccatctcggagagctgtgcaggtaaaatggaagaattctttctctttggagccttcctggaggcctcaatgatcgaccggagaaacggagacaagcccatcacctttgaggtcaccataggcaactatgggaacgaagttgatggcctgtcccggccccagcggcctcggccccggaaggagccgggggatgaggaagaagtagacctgattcagaacgcaagtgatgacgaggccggtgatgccggggacctggcctcagtctcctccactccaccaatgcggccccaggtcaccgacaggaactacttccatctgccctacctggagcgaaagccctgcatctacatcaagagctggtggccggaccagcgccgccgcctctacaatgccaacatcatggaccacattgccgacaagctggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacggtcaggcttctccggcgctgccgtgtgctgtgcaatgggggctcctcctctcactccacaggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccactcttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctctcttgccccacctggctgaggcgccacccttcttcaggcccaggctccagaggaagactcctgaaaccctccccaggtcttccaagtacaggattgaagctttagtgaaattaaccaaggaccatgggtcagtgcccagggctttaaaaagaatgaacgagcaaaaggtatccccgccgtgacccctgcagatagcaccggtctttgatccgcagcaggggccagaccctgcccacaagtcccagcgcggctgcttctgccactgctgggctccacttggctcctctcacttcccagggggtcgcctgtcctgcctgtgggtttccatggcttcccagagctccctctgccccagccagcgcctccaggcccagctgaggagctgtgagaagcagcagaggggactccccatcccgggcacaccctgtcctcccacccctgcccccttgcccttccagccctttcagctgcagctgggagctggcccgtcaagtgctgcccctgcctgtgtctgggtttctgttggctgtttttcttttcttgagtggtgatttttctctaaataaaagaagtcaagcactgaaaaaaaaaaaaaaaa

SEQ ID NO: 12 - DNA, 108496 bp, Homo sapiens
  source 1..108496: mol_type = genomic DNA
gggagagcatgcgggctttttcacccatttggagactctgcctgcagaatcctcaagacattcatttcattcattcgttcactctttttttcagacaagggttcttaggatcattcattcattctatacagatttgctgatactgtacaggttgcctctcagaatccagtgcctgttctcagtacctatgctgactggtaggagggataaagacagccttacaccctgggagaggcggtccagagtagaaacatcagacactgtaggagaaagagccaaagaacaggaggcaacagccagacttgcatgttagatggttggagtctgaaaatatccagagtaaagaaaggtaggtgtaacctagtatttgaaagtgctaaacagcaagccagcgctcagggcaagtggccaggaagctttccaagaaaaacttctgggaggataaagggaggtctgtgaaaggaccgaccgcaaagtcgggcgggtactgcacacatgacccattaactacggctcttccggccttgccaggttcttcgagcgggcacccacccggtatccttccctccttcaaccaacaagtactgaccttgcccgaatgctgggtgctggccctgtgcgccggacggaagggcctgattttctcgcattttctctaagcgctggaggctgcccgcctggggcgtctccaagcactaaaccccacgtggctccatctcctcccccttccccggctacatccatgcgaggtcccttatgccctgctggctgtgccccacttgccagggagcgccttcctgtgaaggggaatctggggaggcccccgcccgtgcctgcccacttcctactctgaaaccacaaacctctaggaaggcccctcgccccgtcgggtggaaaattggctcctcggggttccttcaaccccaaagtccgggggcagggggctgaatttcgatcaccgaggagggcgctagtggaagggggaggggaggaggcgctccctcggccttacccgggcatgagtccagggggcacgtaggcggcattgaactcggtcagtagggtgcccgcgctgcgggaggccatggtgggtgcgcgagtacagcgagcctggcgctccgctccgccccacggtaaacagcggcgggtcacctggcaacggccacggcggcgagcctggcaacgccagctggccccgcggtcctcgcgttccgagacactgcgcccccctggcggccacctcccggagcagccccatagggcgcgcccagaaggcgcctcccatttccgcgagctctgctgggtgacccctgtcacttgccccggcgcgtcggggctctctgccttgctgcctgcgggatgtgcagaggctcagatgcgggagggaggcagaacatcgctggagaggcctggcgggatccgtcttgcggtgacccggcttggaacgcgacgctaccacaaaggacaggccaggtcctgactttggaggtcacgcacgaagcagctgccccaccgtggctcaggcccagaaacctgagtggccttagggtccccaggagctatgtctctccaaggcttcccctgcaccccagctccatgggagttccaggaaggggctctgtagtgggccgcgctgggcgaggttgcctaggacgctgtgtgtaattgtgtgtgtgcgtgcgtgcgtgcatgtgtgcgtgtgtgtgtgcgcgccttgcgaagaggagcatttttcatttttcttcttaatctctagctgatggcttccttctcacctcatcatacctgtaaactactccacaagaggcaaaaagaaaatcatagaacgtctgggtgtgtgatttacatttgtccccaatgctgccgttcattttggggatggcatccgcaggggtagcgcttgccccagagagcaggcctgctgaaggcccaccccctgtgtaatcctccctgtgactgcttcagcctccacatttgagtttctccagggacccttacaccagccttggtgcctagggcaggcacagggccttcggcttttccataaggggtgagggtatggggacagcttccacggtgccaggctcttggtgactcgggtggaggccctgccaccccagctccctctgcagcagtcctggtgtcatgaagaagcctggcagttcccactttgtctccaggtcttgcttcttcccttcagatgccggatggagagcagtgctcccctcgcacttcggttctgtaaatggcagtggatgaagaccgcagacgctactgggttcacagaatgtggctgccaccagcattctccaaagacttcccctggcaaatgccaatgaaatgaaggggagccacaggcttcccagaggctcaggaagcagaaacactgaggcctggttggaaagagagctgtaggcaaaggaacggctgcaaacaaactgggtggaaggaaaatccatccatccttcagaatgcagtcatgtctgtatttttctaaattctcattggggaacatgttctacaataaggaaaacatgagtcaaagacccccagccctggtgaggttgaccgcctacttcctcccccattcagggctgcccagccagtcctgctggtaaacccaccaccctgccttccacctgcctgtgttctagtccatctgtctcgtctgattgggatcctgtgccatccatatcatattcatccctgaatctcagcacctggctctggaaagaattcagtaaatgttcattacataaattatatactcagttaccaaaatgggtaacagaagaatggaaattaaaaagtgggttctggctgggaacggtggctcatgcctgtaatcccagcattttggaaggccgaggcaggcggatcacttgaggtcagcagtttgagaccagcctagccaacatggtgaaaccccatctctactaaaaatacaaacattagctgggcatggtagcacatgcttatagtctgacctatttgggaggctgaggcaggagaatcgcttgaacccgggaggcagaggttgcagtgagcctagatcactccactgccctccagcctgggtgacagagtgagactctctctcaaaaaaaaaaaaaaaaaaagagtgggatctgtctcttaggttttcagaaaggccagctgactccattgagagctgctgagtggaattgctaccattttatggatgtggaaagtgagattcagcatagatcaatgccttggctagggcaggatcatgggctttttcctaaagatgcacagggtctataagaggcctcatgaaattcactcctttcaggggaggacctccagagaaccaaggaagaagatattttctgttgttgttgttgtaccttgtagtcaccaagccttaaaaacacagatcacctgatgacctcatggatggaaaatgctagtgaatttaggtgtttttttttttaagacattaaacttatctagcttttgaaaatttagcattcatacttgtattcaataaacagaatactctaagacatttttaaattcaatatgattagataaatgtgagaaaggtaagcaagaattggttaggaaaaagtgcaaaggaaaaaaacgtaagtagaaaaagaaaaatagggcacagtagcaaggaaatatctagaaggaggaaagaaggctcttgggacatactgtaggttatttggaatgcagaattcaaaagaagtaacctcttgttaccatgctgtgaaaaattagtatttctctttttaacctttagactctgtttcaggtagatccctgagctcactcttttatcctttcaacagtaattgggcatcctacggtgcacaggataccatgtggggctctggggtagagggatgctgtgctccagggccctcctgaggtcaggaggggaaaaggcaagggaagcagccccaggactcagtaagatgagaggaggcaggagcagcacagaggaggaccccaacccagctggggtgcgggtacagaggcacctccaggagcaggcactcaagctgagtccagggtggggtggagggcattccaccaagaatgaatagcaagaacaaggctgcagatgaccctgcacagattccagcatcagggattctggcccccagcgtccctttccttggtgtatgctgctggaagacaggagggggcagttctcttttggtccttagaaatttccctatagacatcccttctcctgcccctagcagcttataacagcagaaggccattcaattctgctcctctggctggaaagcaaacatcagcctggcttaccttcgctagcctgcctgacccccagccttggggtggggctaggttagtgccctggatccttaaacatggcccctggtagcacataagcctctgctgcctccacaaccagccatctccatcatgcatggcctggtcctgagcctcccctcaggcagcagccccagcctctctgcttcctgagattcagaaacagggatcccagggcagggctcagggcccagcctcttgggggcacagtctccagcagggaagaggtgggcgtaggtggacaaatacattcccttcttcttgtagtgtgcccctgtgggtgggagtgccccccgccccacatccaccctacctatgctcatgcccactcctctgtgcccactactggtggcagggcttgcttagcagggaagcagcagagccctgcagaggggtgggcagagcctcccttccaggagctgggagaagacacctgaagctggacagagctttatctgggagccggcggctgctgaataatgaattccaactctgccgcactcccaggctgcacattgggtgcacacacacacacacacacacgcacacaccgatacacacacgctgggctgacaacttggaggggcgggggctgtgaggctctgtgagtcgctgcaggagcagcttagctcggcttggttgccttggtctctgtgggcagcatcggaggggggtcgggaggaggaggaggaggcagcggcagagaagagagaggcgtgtgagccgtgctccaccggctagctccttcccgctgctcctgcctggcagtgccaggcagcccacaccagcatggccttgctcatccacctcaagacagtctcggagctgcggggcaggggcgaccggatcgccaaagtgactttccgaggtagggaagccgctgtctcagagggacgccagctctgagagctggaccagcccatgctctggaggtggccggggataggacagggctgggaggatgggtgggaaaagttctagcaggggctggggcgacgagccttttcacaggtagtcatctgcctgggactgactggccattgtgatttctggaaaatcagggtcccctgttcttccatgcctgtgtctccttgtgcttgccaacatgccagttccccgggcagggcacagagccctctgcctggggaggcagaagtgaggaccacatccctgagctcagggagacccaggaccccctccttctctctctctccctctcctgcaggttgatttccttgagcacagggtgggggccgggtatggagcctggggcacccagggtgactgggagaaaccaggcagccagtagctccctgggccccagagtgatgggggacactgttggcttcttttagatctattcatgggcgggaaccccgggagcccctcgcctctcttctgtctggtcttttctcatccttttcactcctgtattcagcgaccatttattatgatctactgtgtcccaaggataggggtagaaacacagagctgagcacaacccagccccagccccaaggagcctgcatctgttgggcaggcgtggaacaagcaggacaggtatgtgagacagaaggtgggggtgcagcatgcaagctacagaagcagcaccctcacccaggctggtgaccggtggtcagggaaggcttcccggaggaagtaacactcagctaatacccgaaggaccagcgggtgggagctaggagaggaggtaaggactgaggaggcagaggaaacagtgtgcccagagctgagagaggagctgaaactctggaactgaaagaggttccatgtgtctacagctcagagagggtgcaggagcggaggccagagagccaagcagggcaaggaggcgaggctggacctgaccccggggacagcggagcccctgagcattttaagtggggaaaggcagggccaggctgactctgtccttcaccacccacctctgcctctccatgtggttgctgcccagccctgagggttgggggtacttctcactagacatggccccttctcccgagagaggggtctgagagtgggatggggacgaggtggtgagaagggggcagagaggacccccctatactaaagagcaaagtgagccttggggcccaggctggacacagtgtctgcacctctgttggaagggatgggagagaccattggcagaacattccagcaagagccctggggcacccacatcacctacccagaggccctgggatgcccacattgcagcttgtgttcatagggacaggcaggggtggaggtgatggcagtggccctgccggcaggcggaggttaggcaggagggagagggaggtgtgggctgggctgccttttgcctcccaccccaacccactgactgctttctctgcagcaccctggatctccctctgtgtgccacctgcaggctcatgctggctttagaaaaagcaaatgtgtcctttcatctgtgaaatgtggccctgagctccacgggcagcatagtgtggggcggttaagctacaggttgccatcctgctgcagctgtgctggaacggtccaggctgcaccggacaggcccacttgcaggccgagaaaccaaggttcaggggtagaacactgcgcgtggcattcacggaggagctgaggcacggtggtcccagctctcaggacctcatcctgagtactcaatcttgcaagctctttatctgctcctgggccacctgggggccagcaccttgtctgacacccatcttctccttggagcagtgaagggctgggcctttagcctcactgaccacacaggaattagtttatttgcaacccttgctctctggactgagtggagaaatcgcttccaagctccacattggcaggaggtggccatgggcagagctcctggggaagggggctgggcagcaggaataggcagatgacaagcagtttccagaaagtacctttattacaacgaaagatgcctcagccgctcacctgtgtcatctagcagttcacagttgtaggcgccccaaaagaccaacactgaccacaattcagagggaatggacccgctctacaatgttccttagcatctcccagcacatgcaaccactgggggccaagcaagtcctctgcagggggaaacaagaaactggtaaacacgcagagggagacactggccccaggctccccaaggcttttgagtgaaagtcaatgccgggggaggtggtgagggagcccttggtgagctgtgcccattggcagtggccctaggtaggccagagcagctggttgaaatatggcttgaccttctgtgctgtgccatccaagacactaaggaaagagccctcctgggctattgtggaaaaagttctggatatggagtcagaagccctagatcctacctgggttctgccactcaccctcagtttcctcatctgtaaaatgggcatgataataacactcacttcactagattgcttcagggaaaccataggtatggaagagtttgtgggaagagtattcaaatggtcgatgtgtttgtgaggcagccattcccattctccttgggagcagctgctggcccctgaggtatcttctctccagaccagcagagggccccatgtgagatataaagggaagaggagagcacgtctaaggggttccagtctgccaggagaaggcagagagcctggactctgctctgtaggagcctctgctgagatgttccgcaggaacccaggcaggcagacccccgagactcctgttctcatctggctgggtgtgcaccagctttgcccgtggccacctcttttcccactgccctcaggccagtcggcccctcggtcagtgctcccagccagttctgtatctagctcttagttcttactgcccctggctgctcctaagctggtgctgccctgttcatgcatttcctgaacatgctaatatttgtgcacaggcctgggaccctgaggtgaaggggccagcctggccctccaggagtcacaatcccattgggtcagacaggagatagggagtcctgggcgaatctctattgtgcctgcaggccacagggctcagctgggtttctcattaacaaaatggagacagtggtcctcatttagctcagaggcctgcagttcccaggagtaatcaagagtgggctatctaagaaggagccatcttgaccacaggttgctactcaaagagaggaagtattagcttcaggtatttcctttatcaactcctgagatagttccctacatcaatcacagagccacagaacgcagggtgtgaagggtcccgaagttcttctagtccaaccttctgtccagtgctgagcaccaaggctgggggacctggactgtaagggaaccaagtgacagacagtccagggccaaccctgatgtctcccttctctttctatcccctgagccttcttgccaagacatgaggtttggggattttctgtgtgagataagaacatctaaaggctggatctggcttccacataattcactgtggctggaaattggcacaaaggtttgcagggcatccccctccaccttttcattcttactcttcttcccaccctccccctgattcccaccctgctatgttcccactacattcaacttccagccattcccaaaagataccacacccttttacacctccaaactttgagacatcgatcatatttcttctgcctggaatgaccaccctccaccttgagaacgcccattaattctgctcatccttcaaggcccagctcatatgctacctcctccatgaaggagtagtactttgcacacaaagtactcctctagcagtactttgcacacattcttcctactgctctgccaaggtacattgcatttcagaaactggccacacctctgcatgctgcccaagcttttgagcatcttcaggacagacatcagacatggtttctgtctttgagggattcactgtgtcatgggtttgagttcttccactgtggcactgtcactctttggctccatttccccaactgtgagctctcaccccagaactttctatccaaggaggatcaagggactggaagaggcctcaagggccaagaaccaagaaccttggctcttactccttccatcaacttccctaacccagagaatcttctagggctccagaggggcctaacgatttttttttttttttttttttttgagtctcgctctgtcgccaggctggagtgcagtgcagtgcgatctcggctcactgcaacctccagctcctgggttcaagcgattcttctgcctcagcctctggagtagctgggactacaggcacacgccaccatgcccgactaatttttgtatttttagtagagacggtgtttcaccatatttcccaggctggtctcaaactcctgacctcatgatccgcctgcctcggcctcccaaagtgctgggattacaggtgtgagccactgcgcccagtcaagcctaacaaatattagcaagttcagctccagcccataggtgggaagcaagagggattgcgtgtgtaagccagagtcagttaggggaagacagaggaaggagaaagggcagacgggaaaggaggtgggagcaggctctgagttggcccccggagctcagaagggaggcgggagtttttattgagcaggggaaatgggcggtatttaagaagccaccgaagggtcttagttcattggcaggatcaaaggccatgaaagggccaggcgtggtggctcatgcctctttccgagccttactgcgaccacacgtggggcaggatctcaccatctgacagaggagaagaaacatacacacagaggtgaaatgagtgcagcatacaggagggccagcggtgggggtaaatagcaacaatgttcagaggatgacagcttacttagagctacagagacgagggaaaaggagcaggaggaggaagtgcctaagctgggtcttgaaaaactgcccctgtttgtacctatggagatgcaggaagtgaggaattggtgatggaggaaggtgaagtctttttgggtgagggaccgaccagaccagaggccagaggaggagaattgcagccaagttccatgtcggggaagccacaccatgtagctggagcagaggctataggaagtagaagagggagaccagctagggagggagcagtgggcctgctgagtgattgtgcagggaagggttgcagctgaggcactggggacaagatgtccccctactgttggctgcaggctccacctctgactccacattacatttattttccccagtaaaatgagggagccctccctcttgatgataaatatagctactatttggaaacttatctgccgcccctggtaaaggaggcagaatacccagtgcacccacccctgaaatgctcctgcaatgcctaggcctgtctgtgggctgtggtccagcctagcaccccctctcttggagaatgtgaggttggcattgtccctgctgaaggcagcaatagaggggacccttacgacgaccttggcagccggtggctggctgtggacacagccctgcgcttttgttttagtcctaacggatatgccccctgcatcctccattcttcacagcacactcagtccccctcaccacacctgagggaaatcttctctgcctaatgccccacgtagtgaatgttctcccctcctccctcccccagagcaagccattgcacaccagcgaagggcagacagagcacacagaaaattccccagacttctgctttgataggaagtgtattttcatgtaatggaaatgattgtaaaactgccttcccctgcaaaagccctcaggaatatgctgctggaaatgtgcttgagaacagacttgcaaatcatttctctgaattgggaagtcttggttatcttagccacttttaccgatcatgtgaaagccacatctctcgcacccactcccatccctgggtctcatttttttcttttttctgtcgcccacgctggagtgcagtggcacaatcatagttcactgcaacctcaacctcctgggttcaagcgatgctcccacctcagcctcccgagtagctaggactacaggcacgcaccaccatgctcagctaatttttgtatttttagtagagatggggtttcaccatattgcccaggctggtcttgaactcccgggctcatgtgagctgcctggctcagcctcccaaagtgctgggattataggcgtaagccactgtgcctggccttttttttttttttttaactttttatatataaaaaaactctcaaatacatacaagagtggggagaacagtatcatggccctatgttgtaccatccaatttcagctaccatcaattcatggccaatcttgcttcatttgcatcccatcctacttcctcaccccaaattattttgaagaagatcccaaaccccataccattccatctgtaaatattcagtacacagttataaaagataagagctcaaataaataccacatactttgtcattttaaagaaattaataacaattccttagtactataaactaatcaggcagtcatcaaattcctaattgtctcatcaatgtcataatttttttccaatttattaaaagcttcattttaatgtgttttgtaaatcaggtatttaatcatttatccactcgttctgttgaagggcagccatgtgccacgcactgggggatggtggggaatgagacagatgtggttcctgtcctcaaagggggaagatgaccactgcacccatcatcatgaggagctttatggaagggaggcacaggtgcccaggcagctcatggtgaggaaacccacttagcccaggatggggggaagccaccccagtgcgtgagccagagtcagttaggggaagactgaggaaggaggaagggcagatgggaagggagggaggagcaggctcctagttggcccctagagcccggaagtgagtcaggagtttttattgagcaggaggaatgggcggtatttaagaagcccttgaagggtcgcagctcattggcaggaacaaaggccatgaaagggctgggcatggtggctcacgcctgtaatcccagcactttgggaggccaaggcgggggggatcatttgagggcaggagtttgagaccagcctggccaacatggtgaaaccacatctctactaaaaacacaaaaattagccgggcgtggtggtgcacgcctataatcccagctactcgggaggctgaggcaggagaatcgcttgaacccaggaggcagaggctgcagtgagccgagattgtgccactgcactccagcctgggcgacagagcgagactctgtctcaagggggggaaaaaagccatgaaaggctccatcccaggcagaggggctaacactagtgcagacgtggtggtgtggagatgcatcaggggagtgtggaggggagaccggaaggcagggcacgggggacgcagccaaacacggagggtctttggtgtcacactcttagcaggagaatgggatgctaagatcttgttttggagagaaggctctagaggtgaggactgcgggcagggacactggggaggaagcccggggcaggcggagggctgagtgcctcagcaggcgccatgagagaggaaggagcggcgctgggatcaggggagtgagtgacagggcagggcaagagtcaattgtggtcctggggaccaccgcggacccagggatttggggtacagggccttagttgattctcatctagacaggtgccagttgctgacaccctgaattctggcaaacatggagacatcagggtggaaacacctggagccactgccatccaggtgggcgccttgagggccaggccccttggctgctttcccagcagcagcatggagcctggcacagaacagacctggcatagaagtgggagcaaggaacaccgcctgtgggtgcaggagcagtgatcagttagcaacaggggcccccctgcagccagccatccaggcagcaccagacagtgatccatttctctcggtgacagttctagaaaaggctccggagacagggactatcatgtgatcatttttaccctagaccgcttgaccgctttctgtctgaactgatccacctgctagacgctgcctcaacagtcctcgtttctattttattttcttttacttcaaagcagaagggctaatctgctgaggtggagacgagttttcacccactggcttttttttttttcagccgaagtttaaggtaaagtcaggactgcagtttccacaatatttttaccctatcggagagtaaaagagtcaccctcccattatacctcattgtattcccagtgcctggcacagaatgggtactctacacacttgtggatcactgggaccacaagctcctctgtcaccgtaacaggggaatctaggacccagcagttgatgactgtgtgggtggcactgtccaaggctcaaagacaaataccacaggcccttcctgcctcagtgccagggtctgaaaaatgggaaccagcgctttcagtcggttgcagggcaaagtcagagtttgagtgaggacctggaagaagggtttgagctgagccagagagatgggatttatcatccctgccctgcccctgcctctcagatgaatccctgacccaagcctaagtttccatagtgtaaacctggatgttagcagggtgggttaaggggaaatacatgagtggaggtagaaatgatattttagtacaatttgtggataataaagggttagagttccatggggcctccatttagctgagaaatggggaaaatggaaggggtaaccttttccagtgggaggcccagggactctgcagtatcccaagtctggctctgtgagtcattggtgattttcagagagtatactatgtaagaaacatgaggaacagctgctttcttggacaactctttgaagtgaatttctttcttctaccatgccatcaactgtcattataaaattgaagatgtgtttctcatggggaaaaaaattgttattacaagagatatgggcaattagacaagtctcaatacatttcaaaagactgaaatcttacagagtatgttctctgaccatagtggaattcagctaaaaatcaataataagaagattatctttgaaagttccaaatatttggaaattaatgcctttcttaacctatggtcaaagaaggaagtaaaagagaaattatgaaacatttttaactgaattataatgaaaatacaacatattaacatttatcattttaagtacttacagcagaaaagaagaaaagtgtaaaattgtaatctaggtttctgccttaaaaagataccaaaagaaaagcaaattaaacccaaatcttgaaaacattatgttaaataaaagaagccagacacaaaagaccacatactgtataacctcatttacagtcaggcatcgcttagtgataggagtacattctgaaaaatgcatcattaagcgattgtgtcattgtgtgaacatcatagagtgtacttacacaaagctagatggtatagccaactacacacctaggctacatggtatgacctactgctcctaggccacaaacgtgtacagaacgtaactgtattcaatgctgtaggcaatcatagtacaatggtaagtatttgtgtatctaaacatagaaaagatacagtaaatacaatattataatcttatgggaccactgttgtatatccaagtggtcgttgaccaaaacggtgttatgtggtgcatgaatgtatacgaaatgctcagaacaggcaaatccatacagagaggagatttgtggttgtcaagggctgtggggagggagaatggggagtgactgctcacgggtatggagtctccttccagggtgatgaaaatattctggaattaggtagtggtgatgggtgtacaaccttgggaatatactaaaaacgactgaactgtgcactttagaaggatgaatgttatggaatgtgaattatatttcaataaataaaaatcaaacaccccccaccaaattaaacccaaggacagtataaaaggaaggaaatagaaaatagacaacagagaaatttaacaaagccaaaagttggttcttcaaaaaaaattaataaaatagataaaccctagcaagacttatcaaaaataaaaagcaagaaaacacaaattaccaatatcaggaataaaagagggaatatcattacatttaaaggaaaatatgggaatattaccaataacttacctcaataaattctacaactcagatgaaatgaataaatcttttgaaaaacaacttaccaaaactgacagaaaaagaaatggaaaatccaaagagcctccatatctattaaagaaattgaatttgtaataacaatgatgatgatgacaataaacttccttccacaaagaaaacttcagatctagatgatttcactgctgtattgtagaaaacattctttttttctttttttgagatggagtctcgcactgtcacccaggctggagtgcagtggcgcgatctcagctcactgcaacctctgtctccccagttcaagtgattctcctgcctcagcctcccgagtagagcagctgagactacacgcaggtgccaccacgcccggctaatttttgtatttttagtagagacagggtttcaccatgttggccaggctggtcttgaactcctgacctcaagtgatctgcccatatcggcctctcaaagtgctgggattacaggtgtaagccaccacacccggcctgtagaaaacattgaaaggaaaacgtaataacaatcttacacaaactctttcagaaaatagagaaggaagagcacatctcaattcattttttattatcaaaacctgacaaagaccttacacaaaaagaaaattacagcccaatatctctcatgaacacagatgtaaaaatccttaacaaaatattagccaactgaatagcaatatatgaaaagaataacacatcatgacaagtgagtattatcccaggaatgcaatgttaatttaaaagtagaaaatcaaaatattttaccatattaacacagtaaaggaaaaaattcatgattatatcaatagatgcagaaaatgcatttgacaaaattcaacacccattcatgataataactatcagcaaactaccaataaaaggagcttcctcaatctgataaaaatcatccagctaacattatacttaattcagaaatattgaacattaagatcatgagtcaggcaaagttttctactctcaccacttctgttcaacactgtgctagaattctagccagtacaaggtggcaaggtaaaaacaactcctacagattggaaaggaagaagtaaaactatctttattcacagaaaacctgattggttatgtagaaaatcctaaggaatctattaaaaagctactacaattaatgaatgaatttagcaagttttcaggatatatgattaatacacaagaaaataaattttaccaaagacaggaaagacttccaccctaaaaacaaaacaacacaaaatgctgagagaaataaaaaaaaaaaaaaaccaaacatgtagaaaatagattatgtttatggactgaagattcataattgttaagatgacaattctccacaaaatgatctatagactgaatgcaatcctaataaaaatcacaacaaactattttgtagaaattgaaaactactttaaaatttatgtggacatgcaaatgatctagaatagctaaagcagccttgaaaatggagaagagaattggagggttcacaccacagctgacccctgaacaacatgggtccacttatatgtggattttttttttttttctttttgagacagagtttcactcttgttgcccaggctggagtgcaatggagcaatctcagctcactgcaacctccacctcccgggttcaagcgattctcctttctcagcctcccgagtagctgggattacaggcatgcaccatcactcccagctaatttttgtattttcagtagagacgaggtttcaccatgttggtcaggctggtctcgaactcctgacctcaagtgatccaccagcctcggcctcctaaagtgctgggattacaggcatgagccacttcgcctggccatggtttctcttccttatcttttttcctaacattttcttttctctagcttactttattgtaaaagtacagtacataatacatatacaaaatatgtgttaattggctgtttatgttatcattaaggcttctggttaacagtagtctattagtagctaagtttttggggagtcaaaatttatatgcagcttttcaactatatgaggggctggtacctctaatccctgtgttgttcaagggtcaactatatttaattataagtctaactataaagttaaaggaattaagaaagtgtggcattggtctaagaatagacatatagaccaatggagcagaatagtgtccagaaataaactctgtacatataaaatcaattgattttcaatcaaggtgttggatatctagaactaggtatctatatggagaaaaaatgaacttcaaactcctacctcataccatccacaaaaattaatgtaagatggattatagaattaaacattaaaaacttataagcttctagaagaaaatatagaacatctttttttgtattcttgggttaggcaaaggtttcttaaagaaaaattttaaaagactaaacataagaaataaatttcactaaaaacttgcatttcttaaaaattggaaactctctttggctagtcacagagtaaaaaaaattgaaaactcctattcataaaaaaatcacatttaagaaggcaagagaaggcaagtcacacacaggaagaaaatattcacatttatctgacaaaggacttgtagccagaatatataaagaatccctataagtcaataataataagacaaattatgaaattttttatgtaggcaaaagacttgaagagacactccatagaataagatagacgtatggccaataaacatgtgaaaatgtgatcaacatcctgagtcattagagaaatgaagatcaaaattacaaagagatattatttcacatgctctaaaatagctaaaatgtaaaagtctgacagtaatcaaatgttgatgaggatggaacaactgaaattttttttacattgctgataagagtgtgaaatgatgcaatccccttagaaaactatttggcgatttctttcttttcttttctttttttttttttttgggatggcatctcgttctgtcacccaggctggagtgcagtggtgtgatcttggttcaatgcaacctttgcctcccgggttcaagcgattctcctgcttcagcctcccgagtagctgggactacaggttcgcaccaccacgcctggctaattttttttttgtatttttagtagagacagggtttcaccgtgttagccatgatggtctccatctcctgacctcatgatctgcctgcctcagcctcccaaagtgctgggattacaggcatgagccattgcgcccggccagcaatttcttataaagctaagggtacctatcctgtgacataaccattctgttcttaggaatttcctcaagagaaataaaattatattttcagaaaaagactcacatgaatgtttacagcaactttgctcatatagcccaaccctagaagcacccaaaagtttatcatcaacagagaaatggaccaagaagttgtggtataggcatgcaacgggctattactctacaataaaaatcaatacattacttatatatgcaacaacatggatgaatcacaaaaacattaccttgaccaaaagaagccagacacacaaaaagtacattctgtaggataccttttatatgaagtttaaaacaggcaaactgatctttggtgctagaaatcagagcactggttactaagggactagaaatcgactggaaagggacatgagagaacatgtggaacaaatggaaatgttctatgtcttgattgtgtggcggtatacagggaaatgcatttattgaaactcattgaattttacacttaagatccatgaatgtaagtttcacctagttttaaaaaaagaagagagactcacatctaaaatacctaaaacttgaaaaatattatataagatgaggaaaaaaattatttctgattccatgctactaaaaataagctacaaatgtgattcataatagaagaagccatttttatatttagcacataacttaaaggtctaaaggacaagcaagctgggcgcagtggcccacgcctataatcctagcattttgggaggccaaggcaggaggatcacttaaagtcaggaatttgagaacagcttggccacatgctggtgaaaccctgtctctctaaaaatacaaaaaaagttagccaggcatggtggcacacgcctgtaattccagctacttaggaggctaatgcaggagagtcacttgaacccaggaggtggaggttgcagtgagcggagattacgccactgcactccagcctgggtgacagatcaagactccgtctcaaaaaaataaattcaaaacaaaatagaatgaaggagaaacaagactatttagtagactgagaatagctgtttcttattgagggataaactgcaccaaatgctattgtaagcattattatttccttcattttaagggtgaggaaacaagggcaaagagaagttaattagcttcatccagggcacgcaaactaggaagaggcagctgggatttgaactcagggactctggcccaagagccttaacctctatcccatgccccctcgtgcttgtaaaggacttgatgctttacttagactttcccacaacagtttcttgtcatcctcgtgatggtcccaggacacaggctggtccaggataatgacccccggctaacagatggtgagtctgagaccccaaggggttggatggccagctcccaggcctccagaccatgggccgttgtgccgggccgcacacctgagtgggcctggctttttcctgcacgcaggggtgcttgggccctgcttcctggtgctccatgggagtatctggccttcaaaaggaacagatcgatctgaagtggggagagagaaaatacagcaggaccatcactcagagagtcgctgtagaggaagagagggagaggagacgccaggacatgggagctttgtgggagggaatgggactatttgctgagctttgtacagcccagcccaggcagtgcatacaacaaggctttgctgattttaaataacacaaggaaatagcagccccaggtctgagtcaccagcagagttttactctatttctcagctcacacagggacaatagcaatggcaggcactgctgggagataggctagtgggctgggccctggcaaaatcacgacgtccttgaaaacagtcccaggaccttctccttccccttcggatggcccaccacctcaccctctgccctttcgggaccccagcccctctccagtcttgcttccacaggctgctccctgagggcagaccattcttgcttttcccttcaccatcgggactcccctgtcctgtgtccagctccttggaggctctactctctgctctacgctttcaaacatttccttacactgttctctctgcctggatttccctccttctccttgcttcccagtctctctgaatatccagatttcttctggtcttctagcgtcaatgcgtgtgcctctgcaatgcctccttaatccactacattgagagtcattgctccttttcctgtgttctcactttatttacactttttgcatgccaatgacaaaattctgccttgtatcatcggcagaattttccatgtctgatatatctccctctggattgtaatacgctcttaaaggcatcgttcagattcgaatgatcttagtacaactcccctctgtgaaggccaaatggcacacaagccaggagctagaaagccctggttgcctgtggaaatgaatgaacacacatgggctggcagccgtgtccctgcacacctgccttttctcagaggtgtggccctagcagggtaagctgtctggaagagggagctattttgtgcagatggaacattttgtccccttaaatcatgtcccatgaaaggccagcatggcatcctgcttctgaaacaagcactgagctcgtctccatttggagaagatctgtcgtgtgggtatttttaaatggtgaaaggagaaatgggtatatctgataccatggcacttgttacactttaagcacagactctgttattcatactccatctattgactcagggaggagtttatttcaaaccaaacagctcagctatcccaggagcagctgcctcagaaggaaggaggatgctgttctatttcccccatcgaacctccttctcactcgatccacaacagcctttccatgcaaggaagaggctattttctttcaagctttattctccattttccctgtggcaagaaaggtgattggatattgggatttgtaatggttttatctgaaagccatttaaaatgaagctggaatgtcaacaagactgacgctgaatggagtagatgtgaagtggaaatgaacttgaaacaagagatggggttagtcatccccctgatcacttggaacagatgatggaggtcccctgcctctgctccagtgaacagaacagaaccacttgaatactgccagccactgtttgtacataccctcctgaaacggctcttccaaaatgctgaaggacattttgttttcttaataatttggcctttccactgtttctgtatgattgatgtgtttcagcaaaccttttttaaaaaagaatatctacaggtaaatttagctcatcatgtttgagaatattcaccatctctaaatccccagggcctaaatcaatgaggttttagcacattttgaaacagaaccctgatgtataaattctgcaatggctgatttcacgtattttacttcctctctaacaaagctatggaaaaatgcacaagcaggggagggtttgatcctcggtgtttcctgcagatgtgaatctgacaccaccttggagcagggcccctccccaccttctcccaatcctccgctgggttgctgcatttttcactccaagagaccccggaggacagctatatccgaggcttattaaaatcttctaggatgcaaaggcctttggttattcagagcagcaggtctttaggggaagcccccatacacaaacatgctcagctgattctcaatttatattgtgtgttacctgcggggaaaattaaaagctcaaacctcaggcactttccctctcctcccttgattgcccgggggcttgttgttgagatatttcttgttgatttttttgttttttatgtctctggctggtgctaaacattctttctttcccatcatgtttacttcacatctctttgccgtatagatagcttctgctttatggttttttcctccttatctcagatgcagccagcccttccccacctgcccccgccccaaaacacacacacgaacacacaccctttcagactgcatccacactctctgtttcagtggatctgacatcaacgaccccgccacccccggccctcgtcagaggggagctctgcattgaactaggactagctcctgggtcataaaagttgctaggaccctggagagctcttactaaacagatgaggccaccactgacagaggagagaggtcagttcccggagggaacgagcctgctttgctgagcccccttccttgcccagcccccagacccatcacagggaaggttcagaggagctctgacccctccagtacctccttggcctgacgccgctctagcccgggctcccaggttttctgtagggagaggagcacagtccgctccacccatgccatgggcttcatcagtgacaacccaaactcacccccaaataggaatggcttcaacctggagacagcccttcaatgaaatggtttatgctggtggagatttaaaggtattcgtctttcggctgggcgcggtgactcacacctataatcccagcactttgggaggccgaggtgggagatcacttgaggccaggaattcgagaccagcctgaccaacatgcgaaaccccatctctactaaaagtaaaaaaattagctaggcacagtggcgcatgcctgtaatcccaactacttgggaggctgaggcacgagaatcatttgaaccccggaggcagagtttgcagtgagccaagattacactactgcactccagcctgggtgacagagcaagactctgtctcaagacaaacaaaaagggtgtttgtctttcaattgcaaaaatcaagcatggtcactgaaaaaaaattcaaattcacatttcattttgttttgttttgttttgtttgtctttcagccaggtgcagtggctcacatcaaagtatgctgctttcaatatcttctcactctccctccccagggataaccactttcttttttattttatttatttaacttttttgagatggagtttcactagttgcccaggctggagtgcaatggcgcaatctcggcccaccacaacctccgcctcctgggttcaagcgattctcctgcctcggcctcttgagtagctgggattacaggcatgtgccaccacacccagctatttttgtatttttagtagagacggggtttctccatgttggtcaagcaggtctcgaactcccgacctcaggtgatccgcccgcctcggcctcccaaattgctgggattacaggcgtgagccactgcgcccaggggggtaaccactttcagtggtttgagatgtttgtctcttcatagaagaaatatatgcatatagtttgggttttggtattttttttaattaatggagttctaatatacatgctgccttttttcccttaccatggaattgacacaggataataaattaattctaagcaacaaatttttctttaacccatcctgtctctaggtttctcctcacagaaattacaaccccttctcttgtggttccatcccatccctaaaacagtatttatcctcccttctctgtaccattactgtttcttgtgcgaaattgtaccttggagtatgtactgaatggtgttgtactggaggcctggcgcggtgactcatgcctgtaatcccagcactttgggagaccaaggtgggcgggtcatttgaggtcaagagttccagacgagcctggccaacatggtgaaaccccgtctctactaaaaatacaaaaattagctgggcatggtggcggcgcctgtaatcccagttactcaggaggctgaggcaggagaatcgcttgaacccaggaggcggaggttgcagtgagccgagatcgtgccactgcaatccagcctgggaacagagcaagactgcatctcaaaaaaaaaaaaaaaatggtgtttcccttgcactggtgccctgttggctcctggcctcccttctagaccatcagctacctgtgggtgggagcctgtgcctttgtcattggtccatcctctatcccgaggccccgggacatggcctagaacatcagagactccagcggctgtttctcaaagtgaactgaactagctggtgtttcccacacgatggagccccctcgacctgccctcgattctctcctgacttatttctccccacatcttgggccagttccagctggactagcaaagagggcagctttacctctgtgctcccaacatgccctagtgggtggcgtatggatgggggagcctgggacaatgtgtgtccatctcacacactctctacttcccatgccagtggggaaagtgggggcaggaatagagcccgggagggaactgccagagactgtcttctctgctaaggctgacaggaagacggacaaccatgacagtggtggaaggggaaggcccttggcccacggggaatggctgtctggaagctgacttgttgttgggggcctggtttgggcaggaacccctggggtggctgcagaaggaggctgggcttcacagacccctgtcggcaggcaggggctacgccccctatactaggcttctgctcagggcagcagggcccggagccaccagcagagctgaggaggctgcagaggaggctgagagatccatggaggaagaacatggtggaaaagagtgcctgaggtccgcttccacggccactctgaccagcctgggccttctgtgccttagcattcccgttcctaacatggaactcatggcctttgacccgcttccctcacgaggctgctgagagggtcagagaagaagccgcatggggactggcctcaccctgggagaggtgagcaagccacgaggtcccatgttgcatgaaaagtcaaatgctgttaggacgactcccaggatgaggaggtctgaccccatgctcatcgtctggacagctctgaccctagaatttatttcctctttccccacagggcaatccttctactctcgggtcctggagaactgtgaggatgtggctgactttgatgaggtaggaggcccaagactcccccctccctcagccctgagcccagaggggaacagccacccttcgctgcctcttgcgggcacacactggccccaaatcccaggcactggcctgctctgagcccctcacctctcagctgcttcctgaaggaggtggtaaggagggtgtgcaggaactccctcccccatgttccccccagaaacctctgcacaggtgaggcccgtgtgcaaatgacacggggaacagcagcctcgcccacctcgacggccctgctgggtctgggcctgttattccctgtggagaaagagcccacaggtgctgtagacctgaatgtgagccaccagctgagggcccaacgaggcaggcgagtgttggggacgtcgcaaaggccagtctgtgtcagtccccaggggttgaagagcagggcagccccgggcactgaggtaggagccccagtcaccagggaaacattgtcaagcaccccacctgagtgagggcgccatctccagaccttgaggggaagcatagggaacagaagacagtctggattttcagaaacagctctgggggttccatgagaaaagacgtgagctgctggtctattgacaacgatttttctcaatcctcactccagctgggctgttgtcacaattttatcagcaaaggagcaggcgacaccatcccacaggggtgcccaggagcagtgagaggacttacaacgcttccctctccctgcccttcccctcggtacctggccgggctgggagccctatcctcacacacacacaccagctcgagcagcctgcggcctcctccgcctcctcacattctttcgtctatgtgtttgctgcttccagaatctatattcccctctggctgctgtaggttctccagggatgactttggagtgagggccagcagtcatccgtcaccatcttagcacaaactggaagccatgtagtgaccctcaaatagtgtaccccctctctcctggggttggctctcccgcttggctctgtgggggctgggaagggcctcatagcagactgtgcctcttgaggttggctgctggcgttcggctgagcagccaccaggctgacacttggcaccagctgtctccccctcctccagaaaccaggccacacgatgtggctgtgtccatcgacccagagctggagacacagggagcaaaacctcgctcctcactcaggcttaggcacagccatcaaccatcgcggcccagcaccacaccctccccaaccacttcagggcgcagttgccacgacctccctggtacgtccccactgctatgcaggacaggtgaatcactcatttaaagtgaatcactagagctaaggaagtttctgtccttaccttctccccctcctggctgtacaatgacctcagtttctaaacctgccaccatctttgtcaaatggggttggtgatgggtgtgaaggtctctgtgaaatgatgaacaaaatgaagggttatggtgagagtggaatcatggctgcccactgagacagctgtcatagatgcttcaggcttgccccattacacacccggcctgctccctcccctccccatttcctcagtcagggcactgggctggctgggagaagatgccagcagcctggcccagtttcccatagtcctacctccctgggcttctgcccactaatccaccaggcacagcatctgactccctcctcccaagactcccaggggatatgtcagcccaggcgttcagccagggggcaacctgatgccccttccaagggcactgccacccttttccatgcccagcgccttggacacctgagccacaggtatgcacgacattcaaagttaatcaccatgtcgttcctcttcccaactccgcccagcctgcctcagggggagagtctgtctctgctggccctgaacaaggggccacattccgagcatctagtgcatgccaggccgggcttgagatatcccagaggcaggaacctgggctcaacaccccatgatgatttgtatgggagcttagggatggggtagccagagtcagtgtggagagactggggcagggcagaagcagttatggaagaagcacatgactagggtcagagagcagggcacgcgatggggagaagaggctcctgcccggggaaagtgctgcccgcccactggggagacagggaagtttctggttgttgcaatgaggagcctactggcatttagtggggtggggagcaaggatgcagaatgacttgcaatgctcaggccatcccgcacttcccacctgggagccccgtgggaagatggtggcagccccagcagcagcactgagctgcttcccgagccatgccccttccactcaatctccgaaatcatccacagacgaaattaggctcagatggtaactacccttccccaggtgacagagctggaagcggccaagccagggttctgaattcatgcatagattagacctaagccctctctggatacagtgatagggcctgactcccaccacccctgcaaggcccgtgttggagtctctccacaccccctgcctccatttctccctgggcaaagtggcctcagccctggccaccaatggtcagcagtgcacatcccacaaagcaggaaggccaccctcccattccctgttcaggaacggcccggaggcctgggtcagcccagtcccaaaggtagcctggagccataccctggctttaacctttctccctagacccagtggacaagttgtaaacttccctggcttccccctgaaagaatctgcctgccagtggttccagaatatcctgggaaagagccctttcaaatccccctgaaccttcttgactttccagaaagcctcttctctccgtcttactctgcccagggcctgccggagccagcttagtgagacacactggcctgggagtcatgagacctacaccacagtccttgctgaggaacctctttgggctttggattccccttctgtaaaagagagatatgctccctgctctatctgccccacgggactgtcacaaggctaaaaaaagatgaaatgagagacaagaaagcaaatgtctctcacagctctactaggtaaggggttccaagcaagggaggggcccctcctctgctcaggcatgggtgagaggggctgcagcagctgggcttaggaacctgagtggggaggaggatgccatggaagaaagacaatgctctctacaacaatgggtggaaacagagcctggacatggtgtctcctttcccagaggctggaacctgagcccctacatttaacctacaactctggaaaagctagggagagacagagaaagacccagcctttgtgacctggggaaacaggagtagccacctttagccagtttggtttggctctaacacaggccctgtgtggagcaggccccaggggagaggccagagtaacaatagtacttgtgccaatgataagaagaactgctgctatttactgagcacttagtgtgtggcaagatgggctgagagcttgacacaagcattagactcactagaacttgctggattggtagcatcctaggtgataaggagccacaacaggatttaaacccgagtctatctgattccaggacctatggtcatttgtaaagtagacaagactcagccctgccctcaaggggctcagtctagcgggcagatggacccactacaaacaaggagggaccctgggccttctgagccaagaggaagaagaggtctccagcctgggggatgacagggcaggggagtttggccttatctgcccctttctgcttgtaccaggaagtcatggctgttacctcctggaggccagaaacgcacctgtcttgttcgtcattggcctggcacccagcatggagttgagaaaatgttgccgagtgaaagaatgaaaaaaacagtgacgttcactaggactggcacctgtcaccgcaggcctgtgcccagaccgagtgggctcagcagggctagtggtacatcaagccctttgctgtggcctggatagaaaggaagcaggcaaggcacagatgagatcacctaaagggactttagatcaccttgatctctaaggttagagatcatctagtttaaccctcttgtcttgcagttgaagaaacaggtcttagagtggggaagagaattgcccaagaagaccagctgagatctgagatcctacatttaacttacaactctaaagaagctggggaaagagacagagacaaagacagaaacagagagagagagacagagacacagagacccagcctttgtgccctgggaaagtgaaatagccacactcgggatactgagcccaggcctttaagcttgcaaatccgtctctttccattgtactctaaagcagcagtccccaacctttttggcaccaggggctggtttcgtggaagacagtttttccacagactgggatggtggtggctgggggttatttgggatgaaactgttcctcctcagaacatcaggcattagattctcttaaggagtgcacagcctagatctcttgcatatgttgttcacagtagggttcacactcctatgagaatctaatgctgtcactgatctgacattagatggagcttaggcgggaatgctcgctcacccgcggctcacctcttgctgtgtggctctgctcctaacaggccatggactggtactggtctgtggcccgggatatggggacccctgctctaaagctttgtagtgcatctcaatattttcccccaaacctatagccctgtccctttaaggatgctaccttgctgatttaggatggttccaggcccactcagcggccaagctggacataatccagatcattctccaaggtacatcagggaaaccttttttgcagagtcctagatcactggggctgataggatgcagaaccctgtgccccggccagcaccagccaggtcagggctaagcctagaccaggaaactgggtcaggactcagcactccccgggctcctgagatcactccctccaacagaggccctctttccctccctatctgtactacctaccaccttgcttctgtcaacagtcctatcccaggctgctattccaggtctgtgtctgtctccagaactatccaggaccatccccaggactgagaaacaaccctgcatccctgcgttctgcacagcgtcatgcacagagcctggcacacagcaagtgctcagcaaatgttcgcccccagcatggggcttgctggctcgtgacatcttgagtgactgtgtttggcttaactgctacttgagtcccccagcagtaccaggcttcaggagaggattcagtgtagtggattaagccctgaggactgaactccagactaagcatcctgagacttgagtttgaatcctgcctctgccaccaaccagccttgtgcccgcgggcaactctcgcctctccactttcccacttgtaaaaggagcacatctttgccatgttgctgtgagcttggttatgggtaaatgtgctctggaagtactaagtcctacccagatgaaattcttccttcagaagcccttttccttcagtctttttttttttttttttttttttgaggtggagtcttactctgtcacccaggctggagtgcaatggtgccatctgggctcactgcaacctctgcctcccaggttcaagcgattctcctgcctcagcctcccaagtagctgagattacaggcatgcaccaccacacctggctaatttttgtattttagtagagaccgtgtttcaccatgttggccaggctggtatcaaactcctaacctcaaatcatctgcccactttggcctcccaaaatgctgtgtttgcaggtatgagccactgcccccagccccctttccttcaatctaatagctcacaagttcaataccatagtcaggagaggagtgtagctcccaaaccctcaaaatcctcatctcgtcttgctgtgttctcagcatatcaccccaaatggaggaaaggacataaccacaaaaatgaggagacaatgaaaaatgaaattagggaagagaagatgcagtgaaagagacacgtgaaatccacaggccgaggcagaagaggaaagtgatggcggcgaaggggagggaggtggcatgacaaggagacaaggcagttgcagacctgcacagagttcccactgggaagatctaaactaaacacattctgccgtgctgtgtcacttacgactgctgtcacctgtgagatcccatttgattctctcaatagccctctaaggtagatattgtcacccccctcttttcacagatggggaagctgaggcacagctagtgagtggcagagccagggctagaactcaagtctcctgactcaaactcagagtttctgcaacaccacggagactcccagtctgcgtgagatacaagcctcggtgttgtcagaagaacaaaaaagaagcaaagggtgggcatgtcctttggagctctgtgaggtgcccagagctcacagaggctgcctcagcaaaggaaggtgtcagcaatgggagatggggctggaaatgctgtctgggcacagcaagggggcctctgggtgctaggaaggggaatccccacctctttcagggagctgtagaggagccactgaaaagttttaacaaaggagagataaaaagagaggaaaattcaaccccaaaagtctccttcttacagcccatgcctctacttccagggaggccaaatgggagtaacccccagtcccagaccctgagtcacttccctccagccaagaggcccgtcaccctccgaggccccacactgatgccaggaccccacctagaggtgccggcttgatcggtctccaggctgggccttgggatttttaaaagcttctggaatggattgcagttccagccaagatgaagaacccctgagaaagacagagggagacagagacaaagggagagatagagacagagagagaaactgatgaaagaaaacagatgtggtgaggagaagaaagcagacgaatgatgcgggagggaaggaaaagaaatgaggggaaagcctcgtgtgggtggaaaatgcgggagggagacaggggaggaaagaaaggaaactgtaaggtgggagcaagtcagagaccgaagaagctgctgtgactcagtgaggaccctgtcttctccctcacccggaaagcctccaagaagaacattccccgctgacataggcatggactgcccagacccggctgacgaatttctgaaagggcacctgagccacacacctacacacgcttcccctgattattctcatctgcagtcaggggccccggaagccccctgtctcctgtgccctccctgtcccccgactctcactcaacaaactggccctcgccccgcagccaggcagcctccctccccaggtcccttagcctcagcctcccgccaccgttcaacaccccacctccctttcacagggccatctccaaagtcatgtcctttttctcctgatctttctctccttccaatgccaaaatcccacccacagaccctcagggggaccaatcacccctcccctcttcatccccagtaaaccaaatctcggtggctcctgcggccccccgactcccacacagcgccctggctgatgagctgggccttcctgggctgctttatttccctgcagccccataaaagcagcttcattaagaaaaccacacactctgctgagctgccagaggcatccagaagctggagccgcagccgctgaatgaggcctgtgggccgggctgcctccacttcctgggactctcagcgcacccctccgccctgtgcccacctcgcctctgaagccctccctaggccctgctcagaaccctccccaccccaccccgcagacccctctcccgctcctctgcttcttcctccctctcatgccaaggccaggtcctcccttgccagtcctgaagggagatgtcacaaaggccgttttcctgagacaggccctgcccacactgggcagtgacccgcggtgctggcccagtgtgcccaagccctccaagtccccaggctgggagaaggaatctcagctttgggaatggcaaacgtgcagggtgggctcacagaagcctcctcccgagggcctgctcagccagcaacagagtgctccaagtcatgcatctgctctgaggccgagttccttgtttatagagcacagaagccattacccacctctccggccattggaaagactaaatgaatgaatatgcacgtagagcattcagacctctgcataagaaaaagttccccagaaatggcagcgattattactattattatttattactggactattgagcagtctgaatttggtagggtataaaaatggaactaaaaaataaaaagtcactgccttctaccagatctgtcaaaatcctccctgacacggtctctccacagcgtcttgagcagacctcagcgttgtctggtcctgtccagaagggcttcctactccagtctggcatcctgttcacccctggccatcctccttccctcatgcttgtggctcaggatgtggagtgggacagggacccctgctgaggccctccacatcctcccctggtgggcagcccatggaaaaactgtcctcatatcactctaccccacttggccaatggagcgcaaatagatgacttgccacagccaacagtggcaggctgggctccttgccctgctgtactctatgggtctcctgccagtccactgccctgcagatgccactggggatttgcatgccatgctgcccctcttgcaggtatctaatcaccatgagctgtttccccaagaagtaccacaaaaacactacgcctaggacagaattcttcccacctttcccttgcccagtcttctttcccatcccaggaaggtgggctgggtgatggttggaggtaacagggcctttgaggaagccctaggaagatgtctggctctgcccattggcagctttttacagaatggggcactgggccactttagcctctgttttgagccattgttgccacttctagggcaccaggaaaaatcccaatcaaattcctactcatcattaacattgagttagggaggaagcaacgaagaagtggtaagggtgaatctagaaacaatgagttggggacaggctgtgggcctgaccccaataacactaatcagctcaaacctgtccccagtgttaccactggcagagtgaggagtggtttgaactcaacacaggagtctggggcagagcctgtgccagtcagggtgattctgatgagagagagctggaagctcacagctccattcagcacccaccaaaaaccaggctcacacccacattccttgctgtctccctgggacccgaccaccaccctggttgcaccaccctctcccaacccccctcaggagctgggaggccatggaagcagcgctgtgtagggagtcaaaagtcctggtaggtccaggctcttcacctaccacatgaccttgggcaggtcctccaacatctctgagcaccatctttgaaagaggagtgggcaacaatgccggctctacaaggtggttgttggaactaaatgagattccaggtgtcaatgctttgtccctggggagcactgggcccaagtgaggggccactctgactgttggagatccccacaagagattcccctcccacaccccacggctcctacctgttattgccaccgaagccgcagttgtccctctctccccagacatttcggtggccggtggccagcagcatcgacagaaatgagatgctggagattcaggttttcaactacagcaaagtcttcagcaacaagtaagtgtgggatggggcaggaggggctgggcctggacgggctgggagcctgctcttctccttgggctaccctctgtttggggcttaaaaaggggacctacactcccaacctgccctggattgatcttcaaagaccgaagaaatcttgggctggtctttgatccccattttgatccctcttcttgtcttcagaatcccccagttctcccagctgctgtcagccaagaacactccaccctcctatcacctctgctgtctccaaccccatcaaagcttcctgtcttaaagacttaaagctttaagtctccctcaatgccacgctggggtacagttacccactggagaggcgaaaggtggaggggctgatgatctcctccaagagacactctgtagccctgagggcaggcttgacagtttggggtggtggtttaggagtcaggcaagcctgatctcagacactcaggtcagtcatctactgtgtgaccctggaaaggttacataacctctctgatttcaatgtgctcatgtgtgaaaaggacaagtatttacctcaaagggcagctgtgtgaattaaatgagatagatattcactcactcattcaacaaatgtttactaagcgtcgattgtgtatcaggtactgaattaggtgatgcagagggcggggtgcctaccttcatggagcttgcactccacaagtgaagtacacctgccatacgagcgttatcactataaggtgttcaataaaagtagttgtcatccttctctctgggccatgagaagaattcagaaggatttgaacacgctggaacagtggctaagtaatatcttgggttaaaaaatcacagccaggtgtggcacacacctgtagtcctaggtccttgggcagataaggcgggaggatcatttgatcccagtaatttgaggctagcctgggcaacatagtgagatcccatctctttaaaaaaaaatcggttgctcttatacaagctggaggtcatggcttaactgtaacatgtccaagaaggtatggaggtgttagctcactgaggactcagaatgactcaacagtgggaggagactacaaacaaaagaaaagtaggcctcatcctaaatcatactaatagaattaaagcactcctgatctgagcaggagagacaaggagtccactgctctgatactagtggcagagaattcctgtaggcaccaccctatagtttccaggaggaaagggactttaagtgttaccttataacaaatggatgagagcctgaaagggaaaatcatagaggacatattcatccattcatccatccattgatccattcatccatccatccatctatcattcctgttattcatccatctgcctatccatttgtctgtccatcaattgatttatccacccttcctttctttcatccatccttccatcctttcatccatccattcatcaatccatccctccatccatttatcaattcatttatccacccatttatccatctatccattcatccgtccatcctttcattcatcctatccatccactcatccatccatccatccatccattcacccatccttcctttcatccattcattcatcaacccaatccttccatctttccatccattcatccaccacttaccctttcatcctttccattcatccttccatccactcatccatccattcatccatccttccaccttttttcttttccttttttttttttttttttttgagacagagtcttgctctgtggcccacagtggagtgcagtggcctgatctcggctcactgcaacctccgcctctctggttcaagcaattatcctgtatcagcctcctgagtagctgggattagaggtgctcaccaccgtgcccagctaatttttgtatttttagtagagatggggtttcaccatgttggccaggttggtatcgaactcctgacctcaagtgatctaccctcctcggcctcccaaagtgctgggattacaggcgtgagccaccacttttggcccatccttctatctttccattcactgatccatctatcgatccatccattctttcattctttcatccatccttccatccatcatccttccttccatccattcatccatcctttcattcttccatccattcatccatccatccatcttttcacccaactttgcagtcactcatcatacatatagtgaacaaatgctttctgccagtcagacactatgctagtcactggagatactgagatgaggtattgaggcacagtccctgcccctaccctcccagaaggctttttgccacaggaagaggaaagaaaggtgtgtacctagaggcaggatgaggaacaggctgctggaagacagcagacaactgaaagatagccagtattttccagccaatgtgctgtcttaggaggtagtgagctccttgccactgggagagggtgagcaaagagtggaccacattgtagaggggatttctgagtcaggaaaggccccaccatatgggctccaaggagtctctgattctgtgggttttattaggagctttcaaaatctcagctgagtatggggcaagggcatttcagaaatgctgtcagggccacagggaggatgtttagtgcacaaaggccttccctttgcctctcatggcatcacaccattcaggcagctgcttttggcacccacaagcaaggttggtgagacaccccccaccaggggcccccaaggtgaagcagagccttcttccctggggtgagataccatgagggtgtgacctatgaggacaggagaaacaggaacaagtggaaggctcacacacagaccaagtgggtgtgaaaaaggaaggagaatcggaagtcaagcaccagggagggcacctgagagcccctgaaggaacccaaccataggtgccaaagcatccaggagctttacagctcagccactacagccctagctgtgcaggaggggaaaccaagtctcagaggggaacctgaggtcacatgggtagacaatggtagagccagggctagaatgcatgtctgttaacttctcttcctaatccaactcccagaaaccaaaatatttgagcagtgatggtggaaactgagggcatggaagacattgttaaatcatttataatgaaagccaccagcctaaccactgaaatgctggaaacacttgagcccatcaaaagactgctacaaacaaatcagaagtatttgggaaatcgggaaattgactcccatgcagtgaatatgttgaaagttacagcttctattaggtgtttttggtttttgttttgttcagagacagaatctcactctgtcacccaggctggagtgcagtggcctagtctcggctcattgcaacctctgcctcctgagttcaagtgattctcatgtcttggcctcccgagtagctgggactacaggtgcatgccaccaggcctggataatttttgtatttttagtagagacagggttttccccatgttggccaggatggtctcgaactcctggcttcaggtaatagacctgcctcagcttcccaaagtgctgggattacaggtgccagccaccaaatccagcctgtattagatgttcttaagtgccaataagaaggaagacagaaaggggaatagttcctatcctaactctcctcttcttccctccctgcccccatccaagagaaggcaggaaaccccacaaggggaggcccaggcctggtgggagaggttctggcatttctttggaagcctagagaatgcccagggcactgctggctgcagagctgagatgggaaagaagaggtccccttgtggagagcacaggcccaggctgacacaggccagcttgtgggggtcagagtgggagagaggtgtttggaatgatgtgagactcaagtctccccatcctggcatttgcctgggccaggccagaggagcaatgaggccactgccctcaacccccacatggcccagttcagaccccaggctccttctcatggggcagctgagtggaaggggtctttggggtctgcactaggcttagcaatgagcaaagccatggccactgctggggacagtgcctggcacatggcaggctcctgattattttgtggaataaaagaatgaataaatgcccctgtggtgttaggaggcagagggtaggtatacaaggtgggagagcctttgagagggaatcggagtggcccctcttctctgaaggactcagggcactcaagggtgacactcagcatcacatgaccgatgcatttggggaaattgagctaaaagaggcatggaggagctgcctgggagagtgggtcccaggacgagaaatgagcctgatcccatcactgccatctcagagagagagacttgtcctagaagcagagagtagcttggaaactggcccctcacccagtggttctagaggctgccaggaggcagagacatggtatgaaggaaggaggcatcctaggcagaaaccaggagacctccaggtctgcttggccccgtttggaacaaagacctgtgtccaggaaccttgggcttccccatgagaaagaaatgttcggttcagaagattttgtgcatccagctctgcctgtccgggacctctgagggtccatggcctggcctccagcctcctgcctgctaaggatgccagggaccctgaataattcaggagccaggacagcaggagaggcctcgcagggcccaggacacctgacacgggctcccaggggaaagtgatgaattattgacaggattctggtgcccagttgccgctctattgtgatcagtctgtgggcccatctgggctggaggccttttcctgccggctaattacgtggggatcttagctctgcccagccgcccagcccctcgtggggccagacagcctcctgtgaggggtgtcctctttgccatggtgacctggatggccctgtaaggcaagtagtcagaggacatggagttagccccagatcctttgcctgacagccccagggaaactgaggcccagagaggcctcttgtccagggtcacacagcaggttcaggacagtcaggtcttcaccccaggcctcctgacacccgggccagtgctccttcccacagaacacatggcctcacaactccatttctagggaaatgactcagctgtctaaggagcatatgagcccacccttcctcaatcgtcctgggccccactctcccaggcagctcctccatgctgacccatgcagaggagtaagaacctactatgtgtgcagccaggatgcacaaaggccagctgcggcgggcagggtcgcctctggggtcaccacaagggccagagccaggggcttctcctacctcttcctgtcccagcttcttcccaaagaatatctatagaagacgggctgagggatggcatcctagaagcagtgccagggcctttgttttgaaactgttttcatggcaagcactgtgtttttgcttaaatggtatgttacagacctgtagaaagagtcaaggtttataaaactgcttttctttatactttacataaggctgagataatatcaattgtccatgtcaaaaaatataatttttacttttatttgagagaggttggggggtgaactgttaggagttaaaaccccccaagccactcttggaggtgtggcaaattgattcctttaatcttgcaagctcctagcgtcccagtcccaccctccaggccatagacaagctctggctgtgcgaggctgtgcacagcttgaagggtgggggactgcctggacctgcccctgaagcccatcctgcaaaggagactcgccctgtgtaggctctccagatggccagccctgctcattattagggagggaggaggggctggcatccgagtgccggtgttggtagaggaatttcacatgagcagtctcctcaccactgtccggtggaagtcggagggctatagcagaaggagccaaaaccacactgctgccaggaggtggaatctcccttgggtcctgctgagtgagcccacatctgtctgactccagagcccaggctcctcactgtctacaccgcttccctttagggatggaattaatctgcatgtggacagggcttggaccagggtaggaagagtaggggatttgcctggaggccaatcttgctcagcacactgtgtgattaaggcagtggctgaatggactaccagtgacagccccatcactgtcaccaccaccggagtatctagcagggacttaaaagcacatgtcagggaggttgtttcagggattcctcctggaaggggcgctggacaaggtctctcaggttcttcccaagtataagatctgagattcaggcaggttaagcctagaaggcaccagacgcctctgtgagcacttgcagggggaatagctccaccctgccccctgggagtgtcttgtcacattgcagcacctctgcggatcctggggagctgccttggctgttcttaggcatctaattctggagaaagatgtgcctgatcgccccacgctcaacaggtgctcgacaggtcctaggggaatcaaggcagctgaatagccatccacaaagggtaatagtagagcagggattctcaaagtgtctccccagccagcagcttcagcatcacctggaaacttgtcagaaatacacattctcaggccctctcccacccactgaatcagagccctggggtcggggccagtggtgtgaactgaagtccggtggacccagtttggtgacttcacattagaagcttgaagttggccatggcgggagtatttatatctcagaaaccagcaaatgctacagatgagcacctctcctctcccaccagtgacacattttccagcatatccacagaagaggatatcccagccgtgcatgttttcacaagccctccaggtgattctgctcatgctgaagtttgagaaccactgatttagaacaaaaaggggtgaggctgcaaaaagatgagtgtattttttcgtgcccgtggtctactgttagaatgtctacatggtacggaagctaaaagtccccttccctcttcattttataaagaccaaattgagactcaggggcagcagctccagggctcctggcccccagcccagcacttctgtctctggggcactgcctgagctgggagaggtgcatgcagctatggaagaaggcttccatgggctgctctaagggcccagaagcccagttcggctttagagtgaaggagtggcgtggtcagtttcatcctcagggaggtggggcacaatggtggttggggctctgagctccaaaggggagcatttcatatccattcctcatggctgcccctaccacttcctcccctcacacagatgggaagatttttaaaaaatcaatgttcaccctccacagacctcagggtggtagagacatgaagcatgtctgagtcagaattcatctgatacctcacctcacccagatctaccattaattagctgtgtcccttccccttccatggcctcactgtcttcctctataaatctcaggcagcatcagatgatgcccaaggtcccttccagctctcacacgccctggatgcttccctcccctttgtgccttcagctagaaatggtgtgtgtattctaatccactctatgtggaagcaccatgtaagaacgtctgtctgagttccctgttctctcccagagcaacaaacagccttctgactgtggggtgcaatggggttgaagtcaactccatcagcatttattgggcacccactgttgttcattaattcagccagcagatattgagatctctagtgtgctagaaatgtcaaacagaggctagaataaaaagcaccacccatgcccttgagaggttcacagtttagaggcagtacatgaatcacgacaaaacggactgctttggagtgctggctgtgtgctgggggctttgacaagaacactcgcagatgatctcattcagtcctccaacaacaactctgtgaagtagggcttatcagctcatcttatgagaaaaccgacactgagagagcttaaggaagttgcccaggaagcaggtagcttgctagtcagtgtcagagctgggttcagatccctgtctctttgatgccaggactgtgctgttaaccaaagcattgcaccgcctctcccctgctgtgcagttccatgggctctgccatcacacaggttcctgccatccaggaacttacaggctgcagatgtggaatggatgagtgagtgctgttggtgtgggctggaaaccttggtcatggttaggcgggtagaagccggaggagctacttgtccatccaggaaactcaggtcctttcccagcctccacactgagcatctggaagcttctctgcaagggctcagctaaagctggatttcatgcacctttccccgcagtctgtagacatcccctaagggtgctcactgccccttggagctctcccaaggaaatgggcctcccacaaacaaccatccacagtgggacatgctgccctggctgcaaccagtcctggctcctgggccaccttctccagcccagcccagagctggagcaagcccacctgagtcctccccaagcagtcacagcccttgggatgtcagtcttgctcctcaccctggtctcttccatgttaccaccgtgccccctctgccatccccaggctcatcgggaccttccgcatggtgctgcagaaggtggtagaggagagccatgtggaggtgactgacacgctgattgatgacaacaatgctatcatcaaggtgggtatgccccacggagttcctggactttcccatatggggccatctgggggtctgttctccctgcctcacacatggggtggtctggggaatgcctctcatgcatggcgaggtgtcgcaggaggaggagactcaggtcagactctgctggaatggctcaatctgtggccatggctggaggccctgtggcatggcagggtctgctgccccacagtaggcacccctgcccttcctacggtgggaatgcaccaactggtccttccatttggacccagctcaggagtcactaaagaggctccttttgtcatccaaaggccagactgagccctgctggcactcgagggcatgaccttcactctgcacatctggctcgggtcctccctgggagggcagggacctcatttcctattgtttgtcacatcccagcacttttgcgtgagcacgcgtgcactagtgatgcacagtctagaggcacctgacacatgttctaacaaagaaggaagcaaccctaccaggacagcctggccccaggctctgctctgattcttcagtcctcttgagctcagccgtggccactcatgggcagttggcatgatggtgaggaacagggaccctgagtatgaatcttaggctgctcactaactgtgtgacttaggcaagctacatatcacctcaaagtgagcacaattacattatccacctcccaggactattctgaggattaaaggacaatacacagaaagtacttagcacagatatgcacaataaatctataatattgttagctattatttcctgacctcagtttacctatgtataaaatgggactgtgccatggtcccccagtggggtcctgtgtaatatatggccctatgtagtggccaagagaaacagcctcagaagccaggactgcagccacagggagctagaacagaaggaaccctcttctcccatgggcaggggtggcagggagggcttcttaaagttaccggggtctcagccaccacagcaaggggagaaggggtgcagaataagctatgtatggacacccatgggaaggcgggctgggaggagaacacagaaacctggatgaagagtgtagtgtgggaagtgagataagagaattggggagtgagcagggatggacagacagcacagcccatgccctggattttcagaatcagacttaagatgtcagcagaggaaaggactcacggatctcctagcccacttgccacccatctccgctacccattgttatgaatgggaacaatgaagtcctggatggggaatggattcggccacagttgacagcagggccagcacggagacccaggacttccaatgccagagaccaccattttcccataacaacatacttggttccaccaagagggtcccatttgttccagaaaggacatggggcttggagttaggcagcctgggctcagatcccagctccagtacttcctagctgtgtgacttaaagcaagtaacttaacctcctgatatgctaggtaaggtaggttgcaatgttgaaaagatcaaatgagtgtacattaaagcatcttagcatgatgcctagcacagtgaggattcagaaaatatgtgcacctttcccttcccttgggaaatctaagcctgggtgctggagcatccaagcactgagtgagggccgcctgtctggggcacaggaccaagtcacctctagaccagtgaggaagggtgatccctgtgcactgggggggaaactagagctgcaagaaagtaatggctccaggacgcagagcaggaagcccaatcatgactctccactgctaagcctgagcccggttgagtgctctactttttgccagaggaaaaccctagggcagctcccaagattccctccctctccagggtaggaagggtgagtgtgagcctgggccctgggctcctctcccggaggccactttcagctcattctgtccatttccaacaagccgatttctggcgggccgcgcctcatgcctgcaggcagcccttgttctgaggagaggaggtggcctgatcatggggatgctgaacgacactctcggttatgtagacagtggactcggggggtgagtccaggctcagttgtcctgggcaggccaggcccctccaccttgagcaccagggaggagtggaaccaccagcagcgggacctggagccaggtaccagtaagctgacccggtctgcacaagtcagcctttcagagcctctgttttctcatcagcaaaatggggcagaggggatcataccatcctgacctcctccagtgaggcaagggtgtggaagcgctgtgtaaacaccaccaagcagccacatatacggggtggagattgctgtcaccatcccagctgctcaccaccgcctccctcccttcagaccagcctgtgcgtggaggtccggtatcaggccactgacggcacagtgggctcctgggacgatggggacttcctgggagatgagtctcttcaagaggaagagaaggacagccaagagacggatggactgctcccaggctcccggcccagctcccggcccccaggagagaagagcttccggaggtaacaggcaggacccctctggctgcccactgctcccaagacacggggaagagacctggggcctggtcctactgacaggcctctctaggcctagctgggctcagagtacagggctgagcttctggagagacatccaaggggtgggaagatgtttctgtagccccccacccagccgtccacccccgaggtcactgggcagggagcaggagactcagatggagctgcaaggccaaggcctccccagtggccctgagggaggtggagctctaacacagggatggggctagatctcctgcctttctcagagaaggggagttggggataggagggcccctggcctctctggttcaagacccagcagtgtccaccaggtgccggcagcctgacctctaccctggcccagtgaggaggcccaagagagggcagctcttcctgccagagtgaagccaaagatcctggctgggccctggcctttcttcctcttgagaagggagggtacccgggaacccccagaatccagcgtcacgccctgcaagtgtcctgccacctatggatcacaggaagctggatccaggacagctcattccacgtgcactatttttacaaaacagaaaatgcaattgtattactattagagaccaaggggacagaatctgggctagtctagtaagatgttgtccatgggttcctaagtcactaggaattatgtgttaaatgccagtaagtcaagggtgcatctgaaggaccagggtgtgttttgagaagggaccctccgtgccactggaaacatatccctgtaagctccttccacgctttcctttccaagtaaagtttactcagtccctctgctgaagaaaccataggttctaaattagtgtaattgaactgacatacttttatgggacaaatatgttttctcctttgcacttgaatgagttcacacccccttaagcacccctcacacacaggtgcatgagtgcacacgtgtgcacatacacatacacacacacacacaagcttcagaaaccctgggagccagatgagtaatagtaacaaggtcaaagtgaccaggcctgcaacaaacatggcgggactgtctactccaggccagccacgggcatggggcagccccaggctagcttaaagcctgtcccctcagactcctggctctttagcagaaaacccaggcctgagtcctagctctgcctcttactagtcgtgtgacccttggcaagtctctgaccctctctcctcacctgcaaagaaggacatagcaaggaaatccccctgccctgctgctgggagagccggagggatcacagaggaacaggtggcaatggaggtgctgagcgctgcccatgtccaggctggtgacagacaaacaggtttcttgtagcacaacaatgcaaagagtcaggaatcgggttggaaattgtgagaagaggagcagtgctcagacggggagtgaagggatgctgactcagtgggcaccacctggtcctcctcgactgtctccattcagaaaagaggttggcagggctggtccagaaaccagaagccgggctctaagaaagagcttccagagaacaagatcggaagccacacaagggccatcagtcacagggaaaggaatgctgaccccaaatcaggagagctaaggcccattaagtcccatcttgactgtgccactcattggctgagtgacactgggcatgtcaccagcccctgtaggtcagtgacaggaatgggttcagcaagttacatctggctcccctccaactctgaggtcctaagggacccatggatgctccggacctgtgggtcacatccatgggaaacaacatcctgggagcccttagcagccacgaaggcaacctccctggggtggcgtagcaacacagagccagtttctcactcagtcctaagagagtgggccagggtgctgatgggggctctggagagcttagagtcccagagagccctaggcaccaggaatctggagataagagggctcccccgacccttcctcacagcctggtggcttccccacctctccccatcttcgtgtggcccctcccagggtagcagcaagaagcgggagcaaaaggaggggcttcaccccggactgggaattgggagagggtgacagccgaagccaggcacccccaccctgcattgcaggggcagtgtgcaggagcacagtttccctgctgccactggggctgccagcccaggtttgagagcacattggggacaggcatcgctgctacaccttctcccgccaggcctagccatgcagccagcaggcctggttgtggaaaagaggggttgagaaaaattctagagatgggccatttgctggtgaggagaaggtggagcgggttcaagaacttggggttttcctgtagcttaatcctggctgcccatatggggccattgagttctgggtcaaggagtgctgaggtgaggagggggacctggaagctggccccgcagccctagatgttgcatctcacccttgtcacatagtgtgggttctgggaggaagccagagagctctccagaagggacttggccaaccttttatcaggaaaacacctactccttaaagaggacaacaccggggaaggggtgtcagtgcctcacctctgaccccgttaggagcccaggcaggcttcccctgcatctgctccctgccctccatcctctcctgggaaggccaatccccttatagatcagggtattcaataaccacagttccctcttgttcctgctttagccacaatgagcaagaggaaaatcccgttgctggcaagcagcagtgtctcaccggccatcttgaccgttagggtccggcgtggggatcagccgctccctggctgatggggtgaaatgaaggcctgctgggggctgcggggaggtagactgagtgggcaggaaacagcctcagcccagacaggccccgggcagcccaggctggaatcttccacggatggaggggaggctgatgccaggagatcctctgggcactcctcacctctccctccagggcctgggtccaccccccagccctgccctgcctggcctgcttctctgggacttcacccacattcatcctgtcctcactctgggggtcagatggttctaagcaggggcagtgtggacctcaggcctcagctgctgtgacactcactcctaagaccctaagaatctgccatgaagttaccccgttcctcctcagggaatcagtatgggggctctgcctgaatgaccaccaaccccaccgcccactgactctctgccccaacgattccacctcccctaggccctggtcagccgcatgccctctgagccactctgcccacttctctagttcctgccacgaagccctgatttctgccggctttttgcacaatgcccccggtaatgtgccaggaagctgtgctgtgtgacagagcacaggctccactcacagctctgctattgggaacccccctccccatttgtgagatggggctcaaggatgcctcacagaagtgccaggattgagtgaggtgcacctgcgagtcatccacccctgtgcctggcatgtggcaggtgctcagccagtgttcacttccttcctcttcactgactccatgttaccctgatgtcaacttctaccccgagcagcacctgaccctcttgttcaggtgctgtccaagcaccttctcagctcttgctccccaccctataccaagggctctgcagaagctgcccacacaggagccttactggcccaggggcaggtatagggagctcatttactcaaagttcccctcacctccccaggctctcagtgttgcagagatgtaatgaatccctaacctcatgggcgctccactctcagcagcacaaaatcagtgttccagacccttgcatggcagcgtatgcctgccctagtctctggagagaaagtgacttcggccctgaccacactcacatgcacacacatgtgtacacaagtgcccatgtgtttgcacacactcacatgcactgcatgacaccagggaggactctggattctgggctctgctgttgatgctgtctttaggagtcacatcttagagaggacaaagaaagaaatcccagctttagtcttgcagctaaactgtagagacctgagcctttcctcctgagtcccagtattctgcgactatctcctcttctcattttctccacctggcctggctctcctgccctccacgacccccacctccttctgctgcccaaaccctcttctgctggtctcctctctgctgggtctcatctgggaggagtttggggcaggagccacttttctcattctccttattgatcattcttccactccagtggaggcctgcagaagccaggtaacttcctcctatgctggggccagagggcagtggggcacgtgtgcatggtggggctctgagacagaggggcagagagtgggcatgcagaagtgtgtgcatgtggggccagtacatgcagccttaccccaagagtgtttttaaatcggtttccacagcccctagagagctagaaaatcctctgctgccttccttctccaggctgagccccagagttgcagcagctcccaaagctgctcagatgagccggggcagccgggcgcactgggattttgtgcttgagacacattcctcctcctatgctgtgagctcttctccgcttagtagtctcagctgatgtgggcagccgaggcctggctgatgttaacacctttgaattacagactgacctgcttgcccaacgtaaaggttagctggccagcgctggactgcagctgtgctgtgtctaggccttcaggtcttgagccatcaggatatgcagtcaagtctacctgggcaaggcctgtgccagaacagggtgtgaggagaggaataatttgctaattgttattcactttcctgtcttcatcctcattgccacagcactgggaaagcattgagagaacattccagaaaagttttctggaagcctccctaaagtgagataggggggccgtttttccctgctctgagccctggagtggtagctcacttaccgccccacctacacccctagaactgcccccaaccacccgtgtgcactccatagcaggacccccagccctgcctcaccctcacagagcaggcttagcccactgttcccctagaggcccccagagcctgggagctcccaccccattggaggggagcaggggagcaggggagccggtgggcagaggagcagggtggcccaggccgggagggtggccaggctcatctaaccctgtgttccctgaggaagctgcgacccacattgtggaatcatcagatcttagcctggtaggggcgatgagctgaggccctgaggtatcagagcttggggttggaatagtggccacccaggcccagcactgtgggcccctcccatctcccccaaggcagaacccagggccatgggaccccttttctgcagacctaggcttgctaccgtgcgaagctgtggggtgagaggtctgtgggacaaggaggcccccggggagcgtgcaggcccgtggggccggggctgaggccagtgtctctggtccacagcccctcacacgtgtccccttgtctcctcatttcttccccctactcagcaaaggcagagagaagaccaagggaggcagagatgacgagcacaagtaggtgtcccaggcgagggcagacgcaacagcgtctctggggagacagaggcctcctccccacaggctgtggagggcgggatgggctcggctgagagggctcaggagtgggctgtcgtggtagagctggcacgggtcatggaggcccagggaggccttttcacctggccacgggggtgagggatgaggaggggttagggtcgcgggggaggtggccagaccttctggtttccactctgggctctcgggggtgaccatcctcctctccgtgtcttgttcctcctccactgttcagcccccatcctgtggccttcgggcttccctgggagggaggggacagctaaaggctaaggggagaggggcatgaggacctcagggatccctctcccaacaggggcgaggtagggccaggcagctggaggcataaggaggaggaactctgggtaccctttgcagctgcaggtcgtgggtggagttggagacccccagaaagcttaggagaggccaccatttgggcggccctctctatcttcatctccccaaaaggcttcctggaaaaatgaggtcagggtgctgtctggagaggacaggagaagggtcctgcaggtgggaggggctggtcacaagggtctggaaagattcgaaggctgggagttgtgaatgggtcttgtaggcacccctagaagcacactgacatctggaggactctagcattacgggatctcataagggcagtggtagccaaggtggaccatactggaggaggcctctggttaacacctgctcttacagatgacaaatctgtctcagaacaggggcagagctggaaccagaagacagggaagctgacttctgacccagagctcaccatagacccaggaaatttagagaacttgactgtatctaaatttaatctaattctccaaacataccaatgagagctgaaaagccaggagtgtggtcttttttatcttccagataagcaacctgagccccagagatcttaagagatttgctcaaaactgtggcctcaatatattaagaattagttcatctgaagatatcatggaaatatcaggattgtgtgttgaggggtctgaactgatcaacactggtgtgggcttgggatatccactggcattaagatcctggggaactcacagcctcattcattgcttcaaaaaaaggtatgagttctaactcgcatttgttacgcacaagcaaaagcaatgatgatgcagtgttaactctgtagtgatggaggaaatggcgctgtgtaggaagagctccagcccagagacctgaaggatggaggagtttgccaggttcccagtaagggaagacacgtaggcagagcatgtgtcaaggctcagagccagggaactgaatccagggtgggtggcgatgatggggaatgctgagctggggagtcctcttagggagtcctcaagggttcaggtttctccatagatgcttagatgtaaagggcatatgaatgagatacaagcagcctgtccatccccagcttctctgcctgagatcagcgatgctctaaggcccttcttgatgcccagcttcccagtctgtcccaggccagacccacagggacacagactggcctgatccctttgactggctacagttggagtaagaggtacctcacagtgccagcacatagtaggtccaccaaaatactggtttcctagcacttctctgtcctaatttcttaccatctctaattagcacatgagataaagtaaactggcatatagtattgttattattattatgtgtagagcaataggactattgaaagaataggaaaatgagatttctaagaagagattgaacaaatttaaactctttagcctggaggagagaaaactgtggagacagatttcaatctctgaaatgttaatgtgtggcaaagctggttggtatctatctccactgagaagagataaatggaaataaatttaagttgaagttaagttgaagtagagaaacaagattcaacccacgaaagaactcatagtgtgtgacattctgggataggctggtttggggagatgagaaaacacccatcatcttccatgatgctgcttgcttgagccttgcaaagggctgggccgccagcaagaactgaagagccagcttccctgacaatcctggggtcaggacaagtgtgtgtgggtcccccaagccttctggtacaacgtgggcacatgtgcaaacgggccagtttggagacagggtggttcttgtataaagggtcagcctatcctgcccacctatggaaagctattcaaaaactaactgacattcaacacactttcaaagacacctgtaaagaccaaaattatgaaattccctgtgccttggggcatggaaaatttttaaaataaacccatttaggggcgcttggataacatgctccgaggttttgaaaattgggctgtttgagcaatgcaaagaaggaccacagaccctatttctcatagacaggagtctttatcctgattgattacctgaggcctgagctaatgagcctagtagttccagttgaagccagtcatggggcagaagccctgggcagtgaatggactcgacctgcagctcatttatggtcaggtctctattagctttcagaataatccagagacctgaattaatgaaacactcgggtcactaaatttagtttggtgaatgttcccaagtcattatgaatactaagctctacctaggaccctgtgtgcaccacacagcaacacgcttctaaatctgggccataaaatgagcggagaaatcatcagatttatagtttacaataagtgaactaattttagcatttttttcctctagagataaataccagtctagattgtaggtgcatttcattctgaccatggtgaatgtagccacaggaaactcaaacggattctaaatcctcagagggtcctgggatactggcctccccttggctctcacttctcaagctttaatacgcccaagaataaggagccatttgattgtaaagtgagttttcactgagttgattattggcttgttttctttgtctgtttctcaccatatcctgtttttggtaattgtagaactcaactagaccaaatgcagaattttactttgaaaacaaaaaaaggccaggacaacggacacctcaacagcaaattacattttttgaaatctaagtctttcagacaaatagataatcttcaaaattccctgattaagttgacatttatttcaaaactctcctttacagtttgccaagagaagtaggcatactgctttctgggaactggtgctgcaatcaggcagaaaggctttttctatagtgaacttctgatgtgttactgatcagaaaattacaaaggctagtggcagtgatgacatcatgctgtactgatcacaattcagattcattgaagagcaagtctaggagaatcagaggtacagagcctgtagtaagaattctggaaattacatccttcactacacatttctgcatttttaataaagggacaaagacaatatccttttgagatattcccaggcacacaggagtgctaccagtactaccacttcagacagctaaaactatgcagggttggaagggagagatttctcctttcaattgcttcaaggtgtagtagagatagttggacaagtatagtttttgtttgtgtgtttgtttgagacagagtctcactctgtcgcccaggctggagtgcagtggtgcgatcgtggctcactgcaacctccgcctcctagttcaagcgattctcctgcctcagcctcccgagtaactgggattacaggcatgtgccaccacacccagctaattttagtagagacggggtttcaccatgttgaccaggctggtcttgaactcctgacctcaagtgatccacctgcctcggcctcccaaagtgctgggattacaggtgtgagtcaccgcaccggaccaggacaagtatagttttttaaagcctcaatcatttctttcaaatctgtttgtgttaagaaataaagtgactttcaaattcaagggccataagtgccccagggatgcctcaggtccttttccacctgggtgagtccatgggaccagcctctgaaagccactatttcttgctaccttgcactccccccgggactcaggcagcagggccagatcccatcccagcaggccgggcagccggcttctccaggcagggcctgcttctaacctaccatctcagagcacttcccctctggggaagtggggaaggggcaggggagagggaagtctgtggctggagcaggctgcaatggcaaaggctaactatgtaggtcacacatgcggaagggccaaggactccaagaataacacagcctaggaatggccaagaagtaatggtgcaaagtcaaacgctgagccctgcaggagactcctgggtaattcaggagagacatagttgagcagcacggctgggcaaaaaggaatcccaagcactgagacaggaagtgacccacgaggaggcccacaaaaactacacttctgaagctgggcctatggcaggggtcaggacagccagcacccctgtccttggggccagcaggtggggcaaaatcccacaggatgcttcagggcaagccagccagggtggtcctttccccaccatcacacgattatttctggtgggttcattgatctgttcaatgttatgtcaccagcaatttaacatgcacagcagtcccttcccaaatgtttgggtgctcaggttctttttgaatgagccccttctttgtaaacatgggtatgatctgtgagattccacagatgacagcatcctgatctgtaaactatgctggcacacagaccatacctgtacctatgggtgccagccctggggccttttagctaaaatcccaaatggtcaggaatggatgggattcttgcccacagaaaagtgcagtcctacggcatcgaggcaaaggacctgagatgcagtaaaaatattgctggcctagaacacaggagctttctgcttcaatcccagttctgccactcaccgtgtgacctcgcgattattgtcccctctctgagcctcagtctttttattggttgaatgaggagaagtatgtggccctcagaggattgccaggaagatgaaatgagcagacatctgcagacattgcagacatctagaaaggcctttggccctatgtagtctctttttggcctgtatgtgtgtgtgtgtgtgtctgtgtgtgtgtgtgtgtgtgtgtaactcacctcccccatcagaagggaggaagcttttgaaaataattccaaaggcatcagctttgattttagagcctctttctttccctttcttctcattgtcgtatttcagatggtatgctactgaagagtgcagacacatcagccttcttccattcctttttaggaattcaaagaacatgctaatgttccctaaattgtgagctgctgccacgtgaaaagggtgattctcaattgctccctcactgggatatgaacgtgctttgtcctgcatatgaacagtaaagaaaggtcctggggttgggatagggccaggtttggggaataagattggccccacaatcctgaggagaggggcttgaggtttctaggtcatctgcctgaggacagaaaggttttccccaacctcctattgcccagcataaagaacaaggatctggggtcttagaaaccatagtcaagcctccacagggagatgtgtgacccaaaaagggtggactctgctgtaagcgagctccaggttggagcctacacctggctccacctggacctacaggatgatggggccatacccaggaggagggagaacgggaagtggagagagtcaggtatccactcatgcaatatggatggggtaatggaacactgcactttaccctctgctgatcctgctcctggggcttcctggtgccaggaaccacaggctcggctgcagggacatcactgaaggacagtgaggacccctgccccttttcctcagccccgctgactgcaaggcccttcacctgggggcacaaggtcgcagcaagccagaggaagaggtaggaactatggagcctgccataagttcctggggttgggggaaaggggaatttggcagtgagaggggacaggtagaaggggcaaaatccaggaccgaagatagatgggaaagggcctatctccccctttttcatggggaccaaggagcatcccagaacacggagaggttggagaaagacaagtcaggctttgagcaccagggccatctgagaactgaacagctcgtttcaaccacatctcccatctcctcatcggcctctgcccctgagtcctctctggtccctgccccgccgttctgatgctctgtctccagtcctcgggctttctctccaaccagctgagccggggaggatgagcgtggggacactggcagggctcggagctctgaggagactagactgaggggctgggatcagactgaaaagtccaagacccagaggagctccagttaaaacggctctttccggctcaagaccacgttccctgcttgctggggaccccatccctctcctccgtgtgtgaaaggatggcaaaggcggaagtggaggggtctctcactgccctgattccccctcctggctcccaatttgggaagacagatcccgatctgtctcgggaccagtaggtgaggggccgggtccatctcccttctctgatgtgttctctcatgtttggctcttctgtgtttgtgtgttttcctccatgcgtccctctccctgcacctcattctggtggcccccctcacagagccgggaggagcgtgttctccgccatgaagctcggcaaaaaccggtctcacaaggaggagccccaaagaccaggtaggacaggtgccgcgtgagccccgcagccccgcgcctcgcggcgccctcccgccgctttccagcccctgcccggctgccaaaaggccctcctgggataggtcgtcccagggccaggccccacccagtgatgcgtggccctctaggaaggagacgccctagggccgagggagggaaacgggcagcgccctctgtcgggggtgcctggttacaaggctcctcccgccctcgttgctcccggttcttccttcttcacgcagaagcccagtgttttaattagagcagagaatatccatcaagaaacgctgtttggccaactccctatttctggggggaaaccgttgtcccactagtacggggtcggcggcaggcctcgcccaagcgctctcaccaggctgcagcctggcctttggggaggtcctggggccgctggagggcgcggcagggccgggcctgggaggctggagcagcaggtggcactgggccctcccggaggagcgactggagaggggaagacagctgctgcagaggaggcgggaggcctggaggaagacaaggggagaaatggagaggacaggggagctgggagggggccatcttctccatcacgggcccaccatcggggctcccggctgccctcccccagcatcccctctgtggcctactggccctcaggctctctcccccaccctcttgcccccatgccaattccagccgtgcccttcaccttcttaaatggagagagtacagctgctggctgaggaccaaacccagcatccttgggtggctgttcggaatccacatgtctgcatctcattagatgaatacacaccaatgcattaggttctgaattccatcagctgtttgatatggataagttacttcctaagccttcgtttctgtacctgtgacatgagaataacgcccatcttggcagggcacagctctaaggactagagatagtcatgtaaagtcctggtgttgtgcctggaacagagagtatccacccaacaaatggtagctatttattgagaggtgcaaaagtatggattctttattccctaccttcttccataagagatattcagtgcctaagtaagtggtatacaataaaagagcattcaattaaaataaaaaggcaagaccagacataatggccattcaaatccaagatcgggattaggtagaaaaacactgcagttattcaggccataatattctaagcggtagcaactaagtaaacctcgaatttaactctcagctttctggatgccagagtaaaaggagaaatggtcactatctcaccatcagtcagcccacctaaccagtctttcatcttccccagatgaaccggcggtgctggagatggaagaccttgaccatctggccattcggctaggagatggactggatcccgactcggtgtctctagcctcagtcacagctctcaccactaatgtctccaacaagcggtgagtggacgggagccctgcaaccccagctgcccccaccctgtcaggcaggacctggcttgccatgattggaatttgggtagggaagaatcagggctcatggacggcttcttcctaacctaaccttacccttttctgcttttccttgggtgtttttctcacctctctccctgcaaaagcagagcacagcagctgcaggcctgttctcaggtccttgaatacctcccagcccaaggaagccacagacctgcccaccccatatttgaacctattgaccccatgtctgtctctctgttacttctgcctttgattagttctctgtgttgaggcctctgaagacaactaatcctcactattcttggcagtgcttgagtgtttaaagaccatgattctgtccctctgcccactcccaggtctaaccactgccagtgtcctcctccccaacaagcagtccccataccccaggcctgatggtacattctcttcctcagatctaagccagacattaagatggagccaagtgctgggcggcccatggattaccaggtaggtgggcacctggaggcctcatgtctttcagactctgctctagtgggggattctagccggatgtgcattatccactatactgaggcatggatccaggggtcatagagaacaacaagctgaatataagttcccaaagtaagcttgttcctgggaggcattcctagaagtatcatcagtagagagatacaaacccaaagaaaagcttgagaactctgcctatgctaatcaaagcccttccagtatttcatgttcagtattggacttcataaagtgagaagcacctagaaaaaccataaagagaccaagaactacaaaaaagtattcaaacagttaaaataagggcctttgaagaaagttttcctggcatgatttttaaattgttgttttgtattatttgattgctggaagtaatgacgattctgtttatctctggatggtgagactgtgagtgatttttttcttctttttgcttctctgtattttctgagattaacacaacttttttatttgtgtgcttctaagaccagagacaaaagactgagacaaagagaggttgacagctgtaagaatgtgaatgtggccaacagtgcaggcaggacaggtgatgagcatgtctggtggctgctgggacaccatctctcaggaagggcccagggaccctccattgctccagaccctcccttggaggctaacaggactcagctataaatcagaagactgctgggctttcctaggattgagttagaatgctggctgctcagaggggacagggcttgcaagagatctcacctggctgccactgcacttctgtcctggggatgttcggtctgggtatcagcaccaggccccagaatcagagtgagccccatctaccagggtagagctttatctctgatgcctagttccagaccccaagcacactaacccttctttacggacaaccccacctcccctcactcaggtgatgatggaaaggataagatggcacttttctatgtaaaaggtacatctggccatgttttctccagaatatacttcatctcccttcatctttgttttagttagtttccatctactcaggcaactgtcttcccaggtgcctgaaaaacagccccaggcaatgtcaaacggacctgcccctgtggttttaaataacttcaagccattggattccttaggggtttgagaatgccggcccctcacctctgccaaaacccaaacacaaagtgtcctgagacttccgagggcttttccaagggattgggctcagggctttgtttctctgtgtgctgagaactggagaattccaaagaacaacgaccccaactcaggtatcatgtcactggcctaagaggtaaggacacatcaaaaatagagtcattattgttcatgaaacttatttttgaaggtttattctatgccaggcactgtgctaggagctatatatgtatttccattgaagttaatgtaattcttcaaccacccaaatataggtgttactgcatttataggtaagaaagtgaggccccaggaaggtcaggaacttgtcccaggtcgttgccactaagttagccaaggttagagccagggttcaaggccaggggtgtctggccatagccataagagcaattgacttctctatatcaagccttctagacagctgctcccttcgggtccctggttcatcttcatcttgctacttagtgcttgttttccaaaccttttcaaactgcctcctaccagagacttttattaactggaccagacattgtcccctccaaagactttttaaaccgaactgaacaaaacggttgttgtatttaacctggtagcatagtgtttcccgacaagttcattcacaattaaccttgcaaacatttgagtgagagctatgaggatgcaaatgtgaaattattttcacttccaatacatacagtgtataatgcaataaaagcaggccgggtgcagtgactcatgcctgtaatcccagcactttcagaggccgagatgagtggattgcaagaccagcctggccaacatggtgaaaccccgtctctactaaaaatacaaaaattagccaggcatggtggtggcgcatacctgtaatcccagctacttgggaggctgaggcaggagaatcacttgaacccagaaagtggaggttgtagtgagtcgagaccgcaccactgcactccaacctgggcaacagagggagaccttgtctcaaaagaaaattaaaaataaataaataaataataaaaagcaataaaaccagatacgacttcactctcttggagactttgggtttgatgagatataaagaccgcaggaaggacacctcgttggtgagatgtggggagacttagctgaactcagatccaggaagggttgtgagggctcaggaccattctaaaggttatggcactgaaagaagcctggaggtaaaaggaccgcggcgtacccatgctctttgtttcttccatttagaatgcacgtcacgtgtaaactctttcctgattattgccatctccaaggcaagaaaccacagtcacccccctgtgaatgtgcagtttccccaccagagtgagcaacgcttggcacttggcagagatgttcttggtggatcaaggggtcttgagtctctttattaccatctcttcctggcaccaagacttaatacattgtcacccaacatctctccagttttcacctccatttcatgcccctgccactgacctgaggtccccagcctcaactgcatggttgtacctactttctacctggtctccctgccctcatattgcctcctccactccaaactccatgccaccactggagcaaacttctgaaaatgcaaatctggtcatgtcacatctctgccacctggaaaagtggggagtgggtaatggatgttgcagaaggacagtactaaagggcgcaccaactctcatctctggctcccagcagatgttcctgaagctggatcaggtccctgggaagcaggtcacaaagcattattactctcgggttttcccaggacaggggtatagatttaccactcagcattattccttgtgatcgctttcatgaagccactggggagtatgtcccttatcttgaaaggagatggtggaatagtcagctggtcagttggtcccagctgtggctccgtttgcctcttcatcttccaccctggaaaaattgagtcctctgctgatgattggagagaaggatggccaagcccctcccccagaaccctggagaatgaccagccattttttattttttatttcaagtgcatcatttccccttcctagagccccaggaggggtgggaggcagcaggaatggcattccccttcccccaacaccatgcgcctggtggtctttctccagcgccctcagcttcctctcggggctgcccttcaaccagcaatgagcaccctctggagcttctcttccctccgttgctccttcaagcctctgcccaccttcccctccaccctccgcctctactgccagagcttctgcccaggttgtcaccttcactggctctgctacatggaggaagggagaaacgtatgaggcctgaaaagggggacagggagaagtagcctgtcttatggccatgcctcgagatggaaaacataaaaaccaaccactctcttggcagtgggaagaggacttgctgctggcttatcttcggtagatgccaaaactatgtctgtccgcttcccagtcctgagttatagaaagccttttttattgttggtgggggcattagttgtggaaaaattcatggggtttttaaaaatctttggcaaaaaagggttcgtggaagttaaaactctacaaactattgtgcaaagaaggacttctagtgtccgtttgctctcttcatagtaaacttctcagagctaagttagttagtcctatttcctttttagctccctgaaggagcagtgaatattgaacttctgtgaagctccagattctaagcttttacttccgtccctttgtcacttcacgttccaaacggaaatgtttgcttcctagttcaagtgtcacttcatttgtaaatatcccctttcctggcaatgttctcattaacattggaatttctatttccttaacatgattacttctgatgtgtagatttttaatcaccctcaggttatttttcagactttgatggacactggatgatcattttagtggttattctttttcatggaaagggaagataattctctcaagtaaagtcgtatttagaagttgcatcaaagcacaactaaaatatgaaatctccaagatgacaggcatgaaaagcaaccttcggagtcgcattagaagaatgtgccgggctcagtggctcacgcctgtaattccagcactttgggaagccaaggcaggtggatcacgagggagactgagaccatcccggccaacatggtgaaacctcgtctctactaaaaatacaaaaattagccgtgcggtggcaggcgcctataatcccagctactcgggaggctgagtctggagaatagcttgaacccgggaggtggaggttgcagtgagcctagatcgtgccactgcactccagccggggcaacagagtgagactctgtctcaaaaaaaaaaaaaaaaaaaaaaaaaaaaaaagaagaatgtacagaggtccatgcttattctagctggggaaaggcttttcttgttaaaacacacgtttgagagaggcaagtgaatcaatcattctaagtatcatgcacaagctccctacttgagagatcaaccgcttagctgaagggagattctgttggggtcactcacattttgtagagctttctgctgtttaggatgcattttgacacacatgatctcatttaacctgcatacaaccttacaggtagctggtgtctctgcttgtaactgaaaaacacaaggctatgtggtcatttgccctcacacctggcaacatgtcaggtctggggttcaatcccaagttcagcaacccccagtacatgcctctgtctatcttaacatggccaccctgacaggaactgacacctccaaatccaaatgagacctgatggcttaaaatgagggttcgggaaaagtagtagtgatgtcaaaaattactggtgctctggctctctctctctctgtctctctctctgtccttatatctttttagcttaaaaagccaataattggctggtcacagtggctcgtgcctgcattcccagcactttgggaggccaaggcaggcagatcacctgaggtcaggagttcaagaccagcctggccaacatggtaaaacccaatctctactaaaaaaaaaatacaaaaattagccgggcggggtggcatatgcttgtaatcccagctacttgggaggctggggcagaagaatcgcttgaacccaggaggtggaggctgcagtgagctgagatcatgccactgcactccaggcctgagtgacagagagagactcagtgtgaaaaaaaaaaaaaagccattaatcatttgtggtaagctccacaaggaagaatttgttgcaatcccacctgtgcctggctccagcaggtttccaggaaacatttgttgcatgaatgaacaactgaaatagggcttcccaggatataagtaagattgcagagctggacgccacataaaggacacagcagagtgcacacaacatacaatcagtaggctgaaaaaggcggctcaggcaggcaccaaagccgcactggccatacaaacaaagaaattcagcaaacaatgtggaaaggggggggagccaaattccagaaatgcaaagacgtatcagaggcctgcaggcttacatgagaattcctggagcaggaaattaaatgcaagttaatgaagactttgaaagctttattcctgagtgcatgaaacctgtgacatgggtttggcagctctttctgaagcagagccatcgacgctggggaagaacgcagggcacttggcatcacctaggagctttaaaaatacagattccagcctgggcacggtggctcatgcctgtaattccagcactttgggaggccgaggcagacagatcacttgaggccgggagtttgagaacagcctggccaacatggcaaaaccccatctgtataaaaaagacaaaaattagcccggtgtggtagtgcatgcctgtaatcccagctactcaggaggctgaggcagaagaatcacttgaacccaggaggcagagggttgcagtgagccgagatcatgccactgcactccagcctgggcaacagagtaagactccatcaaaaaaataaaaatacagatgcctgagctgcatgtccaggattggattggattggtctggaggtggcctgggcatcagtgtttttaatgcctctccctcccttcggcccagcaagttaagtctagtgaacactgacttagaggttagccaactcatactcctctataaatgaagacacttgaggcatagaaggagaaagagccaggatcacccagcagatgagaggcagtggtcagaatggagcccaggaggccagtgctggctcccgggccctccctctgaccctgctgccccagcccctggacccctgcgggaccaggctcctaggctcaggcagctttccttctggctcccccttctcctgcctgcaggtcagcatcacggtgatcgaggcccggcagctggtgggcttgaacatggaccctgtggtgtgcgtggaggtgggtgacgacaagaagtacacatccatgaaggagtccactaactgcccctattacaacgaggtcagtggccctgtggggaaaggagcctctgtaaatatggcaggagggtggccccagccctccccaggagaaataggagtggctggaagtcaaggagcacacagggctaccagcaggggtgatccaccctgttacaacccccaggacactgacaaacagagccacatcttctgaatcctctgaaccccccagtctagagcacaggccgacactggtctttgaagcgtacaccacccgggtgctcctgggcagaccccagcagtgcctgtgaaagaacccccccccaccccactccccaagaggcctggttcccactgtttcccaggccagagcccaaggacagggctgcctcattccaacccatggtggcactggcaccattagtaagcactttctaccagccaggcatgctcctaaatgcttctgaactggaccatccaaagttgtcactatcaattcccttttacacaaggggacagtgagacttctgaaggcagaccttgtccaacctcacagtgccagcatcgcccttggcgtgctagtggggttctgccctcttggctcggctccttcatggttgcctaaacttctgcgggcttctctccagagcactggccttgattttagggtgtgaaagagaaaacatttggtacccactcctattctttccagccatttgaggccacatcaagggtgagggacctcagagaccttctactttaatctccccatcttacagaggaggatactgaggcctccatatggaagggccttgcccacaatctcagagagtgttgctgatagagcaggggccaggctgcccacccagcttccagcccagggctctggccaccatcacaaatatggcaccttggttcccaggctccagatgggaccccatcataatcagctctggggagggatgtgagaaatagagaaatacactcactcatcaaaacccaaagaatgacttagaggcatgaagaacagcgaaagtgagacttttaataacggtcttgcaagatggagtgtctggtaggcaggcacccctggggcagtcacaacaggaatttatctcctagtgtgcaagtccctcccccacttccccattggttgagcactatggggttacaatcttccctgacgtcgcctaagtttcattttcccccttacaaggttataccccgctccccttcgatttccccacttaagtttcgatttcccaataacaaaactttcttccctttcatgggctgacccctcctctacattctgttcgcttattgtgtccttctaggtgcatgagccgtgtggtttgttgcattcgcaggttggatgccagtacttagacttatcctgccttgaaaatggaccattgaaaatgttttctcaccaggatgcccaggcctttcccagatgcctgatcacacatcagactaacccagaagccacaggcctgggccctgccatccctttcctggagggttccccagtctgtttctcctggtggctccaggcagtgaggggtgccaggctgtcccaagtaaggcagctgagtcccgtaccctgaggtgggtgagggctgaggtgccccctgtagcttgggggagggcatttctcaggcagctctgagagtcctcagactgtgcacctgcaggaagaaaacccaggcccacctctgcccttcagcccaggcctggccgaactctcctttgtgaccacaaattgactctgctctcccagctgctttcccacaggccccccgagctggacaacctgctcaggacccctccagccccaaggacattcaggattgacatctctggccttacgttaggacacatcctgactggacaagtctccgcctagataagcatctatgtccccaagacaggcatggagacaggtccctgtggccccggtggttacttgatagcagtgaagccacttctgctaacttaagggatctccctccaccaggcccacacaccttggctttcattcaaattacttcctctttcccaagggcacagagctgctctccctactctgtggctcccccagaaaactcctactcacccggcagggcccagctcaaatgttcttgctactgagcagccttgcctgctctgtctgggtcagaggtcagcactcccctttctctgcagtgttaatgtcctggagttgaggttggtcctccgtgtctctgtcctgctggtggactggaggctcccagtctcctgcctcgctatttgttcagagccaggcatgtactcggaggggttcagtaacactcacccaaaggaagacacaaacatccactgagcatctgccgcacaccagacagtggcacgtggggcaacatggaggctgccgagatgaaggaggcacagtttccgccctgcgcaggtcccctccttgtttcagcctagaatctttctaaattccctatttacttcctctaagactgactattcattctgctcatctttggacaatcttaaatgtgtttctgatcacatttttgttctttttcacaaacccaaatagctctgattttgtttctgtttcctctaaactagggtttctcaaactcagcactatggtatcttggactggataattgtggtgggatcgtcctgtgctgtgtaggatgtgagcagcatccctggcctctacccagtagatgccaatagcaactccccttagttacagctaccaagtttccagacatgccaaatgtcccctgaaatcgccctcagttgagaccaccattctaaactatcttactatgattccttccagccccaaatcagcctttccagccccaaagctttgtttcccttttcttctctttctatgccacattccttttcaatgaaggacatcctcctcgtcgtgggaatgtattatttctgactaattatctgagctggtaggaaccttcctttggctccattaaaacaacagagggaggtgggaacaatcaacatgacttaggtatctaagctattacaaaaggaaaatatgctcaggaaataacaggaatttgattgcagacagctcagagagttcgggattctggctctagctcagctagctcgctcccctggggctggcacatctgcgggcacctggcctgatcaccctgcctggccctgagcctgcctgtgtgcagggaagctcaaaacctttgcccttccggaacaagctggccattcacaaaccagactaaggctcctttcctgtgtgtcctgtgtgtgcatctggccccgccctgggcatcttgggagcgccaccatccttcctcctgctgaaaatccacctctcccctttgccttggatccttctctttctacagctcaaagaacctggcattgcacagcccaactctgtctttgtttttcttccagccccttcttccttgcctataaggtgttctactccagcatatgctaagtacaaccatgaagacccatgtgtgctcaaggacaggaactaggagtctgtcacctctctctgggcctttcctcattcccacacacttctccagtgacctcctttttccctccacccctccacagtcagaccacttgggttgtcctcacttcctccccccagtcacccctcaatctctgcagggtttctgcctccagatgtcattgacactgctctcctcaaggtcaccaaggacattgctgttcctgagtataatgtccatgtcatcctcctctcccttgatcacccagtttctttcatcccgctgcctgctgctcctcttgggggcccctcacgccactctcctgcttcccctgtctctccagctccatctccccggcctaacttcttggctgaaaggctgtgtcttcttggagccctgacctgggcctgcttcccctcccatgctctccccaggtatctcctccatctccaaggtgtcagttaccatcttgtgctgacgattcccaaatccatatccccacccgcctccccagagcttcagaactctggccagcacaccctgggcctgttagtgtcatgcacagctgtcgctgcttgctatgtgcttaccgtggtgcacacctgtgttaaagacttgaccagggtgtctcattgcaacttcacaaccacaccttgaagccccccaagtgaatggcacccctggagcagttcagcacgacagccctggatcatatctccacattcataggataataggtaaactgaggctcaggcaagaaagtgagtgatctagcagtaacagccaggtggggctggctctgaagctggctttaccctcagtgctcaagggccagcccccagcagccaggagcacgttctcttcggacatttaccccaagcacattggaaatatttctcccttctcccccaccacagttcaccaaagcagcagcccctctactcactgccccacaccctcatcctcagcacctgcacacccaggccaggggaagagatggggactgcaaatgtgcatggcagcccacagcaccaaaggacagtgcacacccatggcatttcacatcgactgccaactaagtgcttggcacaccatggttcatctgctctgaggcttgcgttattttacagtttcacctctctgaatttgggatgtgtctcctaggcagccttgtggcttcatggcaatgtccatgtggcttattaaaccgtagtatatcttacagccagtagccactttagatttggtaaaatatgttacactgtctcatcagagcctcataacaagactctgaggtgggtgtcattatccccatttcacagctcaaaaaactgaggttcagagaatgtgttgctcaaggccacacagttaagaaggtgcagagcggggactagaacccaggtctgcttgctccctggccctgtgcctcttctgagcacagtacaagggcatgggctgtcccacctactgttccaagttcctttcccaccccacactagccagcaccagccccacctaggggatggggctctgcttcctaccacccaccaccagggtcaatcaggatcagatgagttgcctctgctgctcctctgaactttggggctcagggcaaatgtctggggtgcagacaggccctgcgaggagggaggggcccaacactgcctgggctgttgctgctgccctcagtgacagcaggcctggatccttccccctccagtacttcgtcttcgacttccatgtctctccggatgtcatgtttgacaagatcatcaagatttcggtgagtggggagcagcccctggccggcagggccactccctcaaactgcacctttgtgcagacttgagaggggccccctctgtctagacccatgataaagaggcagcgccgtgcctggacacacggctgggcaagtagggacaggctggattctggcccccacccacccctttcattggatgcctctgaatagtgcattcgcccgtaaacagtggccagcaagaaactggcgtgggcaggaggagctgatgctgagcctcagtgagccaccccactctgccaacgccctcccacttcaccacaaagctcgggtcccaccactgccccatggaaagcctcacccttgctgggcctgacgggtgggctgtggttctgcctgaaaggtgattcactccaagaacctgctgcgcagtggcaccctggtgggctccttcaaaatggacgtgggaaccgtgtactcgcagccaggtgagtacctgcgcatggccagtcagtcgaggtgtgcatggctcagggagcgtggtgcacggggcccttcccactgtggcagttcctgggaaaaggctggcaaggaccacagtctggcgactgttagtacacacagccatctggcctgcggagaagtggcgcgcacagtctgtacacaaatgcagtgagcaactgcgcacccagtctggtgggttctcactcataattaggtgagtaactctgcacagagcctggaaggagcttcatcacacgctctggagtgcatggcaggctggtgcatcactggccataggcaggctgaccagtagtggtagaggatgcggtgagggagacccgtcacagcctgcagagaggctgcgcccagactcctgcctcctgggctggcacctgctgagcagaaaagaacccctttccacccctcacaggaccctgccgtccccttttacagttgaggctcagagccagggcttgccccagccacacagctggccgggggtgaagtcaggctgtgtgtccccagagcctcactgagccacactatccaatctgaaagcggtgatgctggtcaatgccagatgtagtgcggcggcctctgagggactctggtctctgaaaacacttcttacaagagccccaggcttttgggcagccatgtgtgctccgtggcgtcctgtagggtaacagcaatggtgttggcaagggaaccccaaggggtggcccagagggcttgtgaggtgggccaggcagaggaagtgcctcagcctgccagatgacagctcaccacgtgggcaggttagggaccaccctgtgtccctgaagtgaatgcactgctcagagtgctgtaatgaccccattaggcgctttgacagtgagaacataatttcacccaattgtcacattgggccctcacaaaacagtaatgtaggcagcagcatttcttcccattttgcacatgagataaatgaggctaagagaaatgaaggggcttagagataccactaaactagtaggttgaacaaattggcgatcgcttgtggttcaacctaagagacgtccagctggtgcacattacaactatgacttagaccagggaatctgagtccaaaaccaagattatacacataaaaatcacaagatcatagaacactcaagctgcccaagacctgaaaaacatctagtccagcctctgtgaagataaactgaagcccaaggtgatgaaggggtttgtccaccatctaggagtagcacccctgtctccagctcccaggccagtgcctttgccaccaccccacacatgccatagccctcagcggagggcagccctgctgaccatcagtgccatggggagcagggaagagtcggcctcctgccatgttgctttccaggaagcatgcatagccgtggactacttgcttggaatgactggcatccctgaggataagctcctcccagggctgagcagtggccctggtaccactggcaggcctgaggccgagagccaagagaaagtcagggggtggagaaaaaggcagatattagtctaatatggacctctgggcttctgggtagtaaagtcctggtgaggaaaccaccagggcatcagtaagtgccagatgttgggctaagctcactgtcccagcaggcctcaccctcacgaccccatataggcatcattcccatttcaccataaggaaactgaggctcagcaggcttaaacagctggtccagggccacattgtgagtaagcggcagaaacaggatgtgggccgaggtctccacttgggtaacctagctcgagatttgctgcttctgctgaatccagccctgagcctggtgccctcccagggacaggagagcctgaagtcacatgggtcctggagttgagacccaatgtctttactctgatatctccagtttggcctgaacttcttgatgagtcgttggttccagccagggcattgttggacagcatgctcccagagacactcctgggtgctgctgggaagctttgggtggtgtcgatatctcttggaactggaaggggtttcccgagagaacctcttctcaccctggcaggaccacattttgtcatttgtaccaccagatgcaacatcaggaaactgtttactgtttgctactctctgttgggggtgaggacgggccatacactcatcctcatagatcatagaggaagtcaggggcatacactcatcctcatagatcataaaggaggtctgggatgcagcaacttccccagctgggctacccttgactggcaggtgtcagccccaggctgaagggaggtgaaatgatgtttcaggctggtaagcatatagctcaggatctcatgtggtccttgtatctctagcctgagatcacacagtattaggactagaagggcctcagaagtcatgagtcaagtgttaacctgatgtagggacccccacagcaccatctctgattggtcctctaaccttgcttagtcctcccagaaatggggcactcactacttcttattttagatatcttcactttctttaggtcatctcaaaatctgtcaccctgtaaccttcacccactttcacacgtctctctttcaggacaaaaagaaaaatagcctttaaatttgaaggtaaattttacattcctcctgaaccgtattctctttctttgctaaatgtccccaattcatctaaccatgcacacctctatacatctacccctgtatccatccatccactcacccacccatctacaaatccatccacccacctgtccacagatccacccacccatccatgtatccatccattcacgcaccaatccatatatccattggtccacccacccacccatccgtgaatccatccacccacccacccgcctgtctacagatccacccactcacccatatatccatccatccacccacccacccatccatatatctacccacccatctatccacagatccatccacctacccacccatccacagatccacccacccatatatccacccatccacccacccatccatatatctacccacccacctgtccacagattaatggctccttctatccagtaatccattcaccatctgtccgtctatctctcagccggccaggcagctcaccacccatccctctgcccatttatgcacccattcattgagctttctgtccatctcctcatccgacacacatctgctctggcaagacctgaagctcctgggattcctgggacatggcccctccctggaggcctgccagcctggctgaggttctccagtgactcctcatccacgtgccttcctgccctctcaccttgcttgtccctctcttcagactctactgtggcattatcttttctgagacacaggtggcctggctattcccagaaaggccaacctctgtacacagcccctaacatctccgggagcccaccagggccacaggcttgcaggacacaggcctgggctacggtagaaggtggaagaggagggagtgaaggagggaggtgctgagtccctgagagttcagtgcccacctaacatcccgggaagcagattcctaaggcacagtgatgcgcttccctttgcttgcccactgggcttaaagtaaacctgaaggggcaaatccttcctaaagcgcctccttccctgacatccgtcctttcctccacacagtcataggtcatgggacactgggatgagactgacaatccctgtctttaggagactctcagtctaaaatcagagccaaacaatacccagatcagcacagtgagatgggaggtgtgcatggagagcacagagaacaaacactaaagagcccaggatcaactcttccgaggaagtcagggagggctgcatggaggaggagagacttgagcaaaatgagtagaagtttacaaattgaatagggagaaagacaggtggaggtggagagaacaggaatgagggcattccaagctcaaagagcagcagatgcaaaggcatggaggtataaaagggcatataaaaccgcaacacctgttcagcaaggaggaacacagggctgggtgggctcagcagagtgagtcagggagcactaaatcaggagcctgcaggccatgccttttgtcttcaccccaaggcactgggaagccccagaggggctgaagatggggagcaggagcatgagcctccacctgggaaggccctgtgtgcagctgtgtccttcacagctatgtgaaggctggctgactggggtggggccatagaagaggccacaggcagaaaaacccaattaggaggaggctgtcgtgcttccaagtcacaccactcatgggatatatgtccatgggcaggccatgcacccactgccccagctccagaggacctcagactctatcacaccctgggctagggacaggcagagctgtggccccaggtcccgggactctagggaccaagacagcatttggttctgccaccccttggcctgccctgagcactgggagacgctctgggtgggggtgtctggtgcagtgcccacccctcatcattgcagagcaccagttccatcacaagtgggccatcctgtctgaccccgatgacatctcctcggggctgaagggctacgtgaagtgtgacgttgccgtggtgggcaaaggggacaacatcaagacgccccacaaggccaatgagaccgacgaagatgacattgaggggtgaggcccagctaccccagcccctggagtctgagccagcccttccttcccccagggagcccccggtgagggtttgctgagagcacctgccacccgtctccctcaccctgctctcgctcactctcccaagcagccccactcttccgaggcagggcaggggcagggggtgatggaggatggctgagaatatcagtcctttgacatcctttctgccagtgagaaatgggttgagaagagtcgatgctggcagaccagaaccagcagctgctgggtcctgagtatagcagcaggaagtgctgggagagccaaggtttcttctggtgtgccaattccaggcagctgatagcagctgttgagaaatattctgtgaccttgtctggagtcagtgggtaaaagtgctgggaatcaatgaatcctgtcttttgtgagctgggggagagagagtggctactgtgaagtttttgtctacgaaacaaaagatacggcacaaaactataaaacactgacaataatactaagatcatatcccaatgtacaatctacaaagcactcatatgttttagcgtgcttgagccgatcatgttcttgggaggtgggtattattacagccacctcaacagtgaggaaacggcagctcagtgagatgggaagatttgcccagaatcccacaaggggcaagttccgtgaacacaagtgtctaatcctagccttgctccctcagctgtcccttagagactgtgccaggacccaggagtgtgtagatgccaggatgggggttggggacctggacctggtgaccatggccctggctgtatgtgctggcaggaacttgctgctccccgagggggtgccccccgaacgccagtgggcccggttctatgtgaaaatttaccgagcagaggggctgccccgtatgaacacaagcctcatggccaatgtaaagaaggctttcatcggtgaaaacaaggacctcgtggacccctacgtgcaagtcttctttgctggccagaaggtactggggtatgaggtacaggaggctggggctgggtgacaggtatcacaagggcaggctgatgggtgtggggcctggggcagctgggcaggtaagacaaggctggaaatcatgttggccagggacggacttagaggatcctcactgcctcctggagtccttagactgagagctgcgcagggggcatgagagggaggagaggctgggggtgtgggaagagtggagacaagtccacacacaggcacgcacacacacatgcacccactcatacacgcacgcataccaactcacacacgcacgcataccaactcacacatgcagacacgcacccactcacccgtgcacacgtgcacccacgaatacacacacacatgcacccattcacacacgcacacacacccactcacacatgcacacatgcacccactcacacacgcacacacacccattcacacatgcacacatgcacccactcacacacgcacgcatacccactcacacgtgcacacatgcacccacgaatacatacatgcacccactcacacgcacacatgcacccattaacacacgcacacatgcaaccactcacacacgcacacatgcatccactcacgcacacatgcacccactcacgcacacatgcacccactcatacacacacatgcatccactcacacacgcacgcgcacccactcacacatgcacccactcacacacgcacacatgcatccactcacacacgcatgcacacccactcacacatgcacacatgtgcccactcacgcacacatgcgcccactcacacacacacacatgcacccactcacacacacatgccacgccctcacctgtgctcccccttccaccagggcaagacttcagtgcagaagagcagctatgagcccctgtggaatgagcaggtcgtctttacagacctcttccccccactctgcaaacgcatgaaggtgcagatccgagactcggacaaggtcaacgacgtggccatcggcacccacttcattgacctgcgcaagatttctaatgacggagacaaaggtcagcagcgggagacccggtgtgctggggggcagagggagtggcctgaagggaaggaatatgtgagatgccctctcttcacaccaccgtcatcagctctggtcctcagcctcacaggtgcttccagggccttgccagcagcccctgcctcagggggagggtgaggatttgtggctcaggtcggctcagagctggcctgagcccagctgactggatttgtcagctagtagttgtgtgacctgttttcccatttgtaaagtgaaaataataatgattatatgatatgataattatagtatgatatgcacattatagcagtgtatatactgcatttgtatataattacagtgtgtgtgtatatatatatgatacctaatagtagtgcctatctgcagaatcgcagggattgactacctcctaggatccctgccctgtgctgggttccaaggacatagagtgagataagaatctattcctggatcaaagtgctcactgtgtattgaggagatagatgtgctaccaaatggtcaaaacataaggcagaagacacaaaaggccacatgttgtctgatccatgtatgtgaaacatccggcaaatccacagagacagaaagtagattgccggtttccaggtgctaaagggaggggattgggactaactgctaaataggtgcagagtttcttttgagggggtggaactgctctggaagtagatgatggtttatagcacagtgaatatacgaaaaaccactgaaatgtacactttaaaagggtgaattttatgtcatgtgaagtatatctaaatttttaaaatgctataagtgtgttttttaaaaaaaggcagaataaaaaggaaatgaaccaaaaaaactggatcatgagacccctgtcagaggcctgacaaatcttagccataagagaagggacttgtgcctaggaattgggaaggcttcgtgaggaagcagcatttcacaggcagagatggagagggatggccttcagcaaggaggggaggggtctgcactggcagggtcaccgtggtgggacagagctgcaaaaatggcacagggcccaaggtcatgctgcggacttggaaggactggctctgtcctacaagtagactgttgacaattcctgctctaagttccaggaagcagggagctagactttgccttcccactgcttccagctcaggcccccgcagggaagaaatagacccaagagagtgctccaccccagcgcagtgtaagaaggctgccccacacctgaatggcacacatgaagttctcagctcagcacccaggagctggaggccagggacccccaaaagaggcccctcttccccagggaaactggatgtgacgctgccccctcatttttgttcccactgccacaggcttcctgcccacactgggcccagcctgggtgaacatgtacggctccacacgtaactacacgctgctggatgagcatcaggacctgaacgagggcctgggggagggtgtgtccttccgggcccggctcctgctgggcctggctgtggagatcgtagacacctccaaccctgagctcaccagctccacagaggtgcaggtggagcaggccacgcccatctcggaggtgagaccccaggcactgtgctgtcccccagggcctccagctcagcccccttctccctgagtcacctgggtcccaggctttgcctgttgctgccctgtctacctgaggagtcatacctcaggataaggcttctccccaggaagcagaggcccccactcagccccgcaacaggactctgccctcgtccactgcctgcctgtgctctgtctcacaacggccgccaggtctcacgatggtgcctcccctctgcccctcttcccagccacggctgtccctgtggtgtctgcagccagccctgcttccatggatatccaggctggggggccgttggggtgtgggctgcctggccccaaagccgggtgggatgcccccaccatccacccccacggcctgtctgtgagacggaaggaggcctggcccccgacctgccacccttactcaagctcaggaacgctttgaactgcctccccacagagctgtgcaggtaaaatggaagaattctttctctttggagccttcctggaggcctcaatgatcgaccggagaaacggagacaagcccatcacctttgaggtcaccataggtgagtgctgggcccacgggggcttcgggcctaggtgagtgctgggcccacgggggcttcaggcctaggctgcaggtggtaagtgtgaggctctgcacctcagccctgtcctcactcttgtagggaacgttgacccctttcccctgagaggcctcaagcacccacaaaacacctttgtgtgtgcatggggtggaccacgccccataaaggggccaaccctcagctccacctacagggtgaggctgtgtttgggacctggggcagagggcagggagaagcccttcccggggctggagaggagagagtgggaactcaggccacagcctgggccagggctgggcctcgcactcaggcgtcatgaggactccctgactctcagcggagtggggacacgggctaatgctctctggctaatgatgtgtcacgtctgagccccattccctgactctccctctcccctttcccaaacccaaggcagcaccggattggacggtgggaggggcctggtggggaatgcactctaggccttctgggcccattctgctccaggcaactatgggaacgaagttgatggcctgtcccggccccagcggcctcggccccggaaggagccgggggatgaggaagaagtagacctgattcagaacgcaagtgatgacgaggccggtgatgccggggacctggcctcagtctcctccactccaccaatgcggccccaggtcaccgacaggtgggcccagcctcccatcctcctgtggcctggccctcccacctccctgggcccccaagacctcacctcccgcctctgcccaccccaggaactacttccatctgccctacctggagcgaaagccctgcatctacatcaagagctggtggccggaccagcgccgccgcctctacaatgccaacatcatggaccacattgccgacaagctggtcagggccaggccaggggccagcaggggtggggtcctgggggagacggcgctgtcagagggccttccctggaacacacaaagctggtctgcccagggggctgcaggaacggccccagcaggacctctgttcccattctcagccccaggtcccagggcacagacaaggacaggagccacctctagtcactcagcctccagtgaatcctggggcaggagtgttgggttccctgatttttccagaaatcttaaaagcaaggctagggagacaggtgtggtggctcacgcctgtaatcccaacactttgggaggccaaggcaggtggatcacctgaggtcaggagttcgagaccatcctggccaacatagtgaaatgccgtctctactaaaaatgcaaaaattagcggggcttggtggcgggcacctgtaatcccagctattcgggaggctgaagcaggagaatcgcttgaacccgtgaggcggagtttgcagtgagccaagatggcgccactgcactccagcctgggcaaccgagcaaaacttcatctcaaaaaataaaataaaataaaataaaacaaaataaaaaagcaaggctagggaagggaaatggggaaaagggagaagcgagcagtgtctgaagctcaggagctgccccctcctcctctgcccacccctctccccccatgagccatgggcactgactgggcgaggagtgcagctgttggcatgagacctccttctccccagcctggggaagcagggaccagcagataatcccgcccttccctgagctgttgctgttccctgttgaagttccctgaagctcagccagctcatattttataaaaatgaattaaaacctccaaaaaaatcaaggctaatatgaggtctgctcccagccccctgccaatgtcctccttgtcatccctgtcttgtgactataaccacaattaaagcccatagcctttgcagtgtgacctgggtctgcagttatctgcaaggcttccccctaaggagctggggtacaagctgacctgtgtttcctgtgggacctgggtctcacagccctcccagtgctctcagagccagagccactccctcttcccccaggcatctgttcccatcccctgccacaggctccagcattctggagtgacgtcaggatcttggcacatccagtcctagggtttccctctgtctctggccagccctgagccccgtagccgtgagttctgcccaggccctgtgagctcaccagagccacagactcacagcccagaggtggcttcttccttcaggaactgaagaacccccatgaacaccaacatctccaggttctgagaacagaacctgggaaattgatgacttcctcatgatgaccgatactcaggatggccctagcgagagctcccagatcatgaggtccctcactcccctgatcaacagggaggaggcatttggggaggctggggaggcggggctgtggcccagcatcacccacactcctgattcacaggaagaaggcctgaacgacatacaggagatgatcaaaacggagaagtcctaccctgagcgtcgcctgcggggcgtcctggaggagctgagctgtggctgctggtgagaagggaggggcggcaggtggggggaggatgaggcggaactggacaaaggggaccctgccagggctgggcagatgaggaagaatctacagagcccctgctggtcaggctcgctaaaccccggctcgccctacccccagccgcttcctctccctcgctgacaaggaccagggccactcatcccgcaccaggcttgaccgggagcgcctcaagtcctgcatgagggagctggtgaggacgcaactggacggcgggggctggagggagggcctggttgtgagaaggtgtcacaaccccctttgtcatggcccgagctgtcccccagttgctgggttcactgacaccccctccttcgcaggaaaacatggggcagcaggccaggatgctgcgggcccaggtgaagcggcacacggtgcgggacaagctgaggctgtgccagaacttcctgcagaagctgcgcttcctggcggacgaggtgcggcccaaggggtcggggctttgcctcatccagggctggctctctggggcccctcaggatcagggggctcaatcaggaggctagacccccttacccactgcccctggccaccccccaacccccagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaaggtgctggagggggcaggatggatgggggcctgggtcctttcaggggagcagcagcccccacctggggctggaagcctgagtgacagggtggggccttcaagcagcaggtgctcagagaagagccaagaatgggaaggacgtgggggaaggggtggggaaggaggtgggggaaggggtgggggaaggggtggggaaggaggtgggggaaggggtgggggaaggggtgggggaaggggtggggaaggaggtgggggaaggggtgggggaaggggtggggaaggaggtgggggaaggggtgagggaaggggtgggggaaggggtggggaaggaggtgggggaaggggtggggaaggaggtgggggaaggggtggggaaggaggtgggggaaggggtggggaagggggcatgacggccccctgcccatcctcctgcctccaccggaccccagcccagcgggatggctgtgaaggggcagggcagctctgaccagggcctctgccggcccctgccccttccccacctcttgggccctggcagccgtcaggctcctggtgaccccatgcccacccccagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccagtgagtgaggacccctcactcgaagcctcacctgggagggggccggaggggctgcccatcctggaacctcaggctgcccttccccacagagaagcaggcgttccagctccgagcgcacatgtaccaggcccgcagcctctttgccgccgacagcagcggactctcagacccctttgcccgcgtcttcttcatcaatcagagtcagtgcacagaggtgagggcctgggaggagggagtggctctggctttgagagcaccagaagcctgtgagcctgtggggactggagcctgtggggcctgtgagcctgtggggcctggagccacaggtcagccagtgccccggtttctcaggggaagccctgcagataactgcagcagacgcgggtcacactggaaaggctacgggctttagctgtggttatattcacaagacagggacgacaaggaggacattggcagggggcttgggccaaacctcatattagccttgattttaagatttctggaagaatcaagacacctgtcactcctgcccccaggttccgtggaagctgagtgagtaggggtggcttctgtttgtgcatctgcccccccctctgtcacttgtcccctgtctccccatcccatgctgcaggtgctgaatgagaccctgtgtcccacctgggaccagatgctggtgttcgacaacctggagctctatggtgaagctcatgagctgagggacgatccgcccatcattgtcattgaaatctatgaccaggattccatggtatgggtgggctctggtgccagggaccccagcagcaccacacctggcccttgttccctgcactccacctgcgctgaggctgtgccctcacctccgccacccacctgcagagctccttggccaggtgctggctgggaagctgggagtgggggctgacatctagctcctcctgcctgcttgcggcagcctgaccccttcccaggccagcacatcctcacctcctgtctcctacagactgagccctggaggtgtgccagcaagtcctgctgtcactagcctccccaccccagggctccccgacccctgccctcacctaccacaaccagtaacagccttgccatcctccgtggaggttctggagcagggagtaagggattggggtgacccccgagagttagcgagccaccttctcacataccacctcagctgctgaggtgcccagatagccctggactagaggtaggaggacctcatgtctagtcctgagccgggcatctgccatttactgactgcttggccttgaacaagtctttggtgggccctgagacttggtttcctcatctgtaaaatggggtgatcacacctgtcccttacaacaactcatggcgctgtggtaaggaccaaacgagatcacaggtgtggacagcaagcaccaagaggcttctgggttgtctgttgcgtcagggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcaggtgggactgcagggaagaggggctgaggcctggggactggaggctgggagttggggcctagggctgggggctggaccctgaaggctggggcctggggtctggggcctgggggtggggcctgggggctggaggctggggcctggggctgggggctggggctgagggctggggcctggggcctggggggttagggcctgggcgttaggtcctgggggttggggcctggagctggggcctgggggctggggcctaggggcctctctcctacccatcctgaccaaagctgggggcgtggtccttagggggtttccctgtctccccagatcatggcaaacaactcatggggaaagagaccctgtccctgggctccccagtgtgtgacctgtgacccccattccccagattggaccagcagggaaggctgacctgccccccatcaatggcccggtggacgtggaccgaggtcccatcatgcccgtgcccatgggcatccggcccgtgctcagcaagtaccgagtggaggtgcgagggctctgtgtggcccttcccttttggatgaggagtctgaggacccaggaggggaagtggcttgtcatccccctcccaccaccatcaccaggagccagcagcagacccaggctcctgccccagcccagggcctgcccccatctgcaccaagtcgcactcccatgtcccaggaccatgcccagccctcctgtctgcacccctgaccctgcaccccttctccgggcagccccaccctcatccctggagaacgcctgcccctcctctgctctcctggccctgctcccaccctttgaaatctggggtgaactactgcccatcccactgcccggttccctattggatggtccagcacccccatggctggctcccttgactaaggggctctcttctctgcacccaccctccaacctctcccaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggtgagtgcaggccctggcggaggacatcctgtggccagtgtggctccactcagccagccggcttcctctgccccttcttggaggctcaggctcctgtcgccaacaccccaggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacgggtatggccacatccaccctgccaccaagcctggctccacgccccccagggaagggctccaggtctccgcccagtccaagccgcgaccagagtttgctctttggggccgagggggtgggcatagaagaaggtcaccctggtggccaaggaaggctgcccaaggtgacgccagctctacagccagagagggcagaactggagacagcctgggggggcctgagggcagaaagccccttgcgctggttgatggagaagacccaggcctccccgccacctccctcccaccggcctccgcagcttccccttatctcgggctctcttcttccctccccatgcccatattttctcccttgactgcctgtccccctctccctcagaaagttccagaatcagctttagttctccgcaccttcctgccccgccaatctcactgttcctcttgctccttcctctgcctgtctgtccatctatccatctgtccagtcaggcttctccggcgctgccgtgtgctgtgcaatgggggctcctcctctcactccacaggggaggttgtggtgactatggagccagaggtacccatcaagaaactggagaccatggtgaagctggacgcggtaaggcgggtggggtcagccccctgctggctgggaacatgcaacttcgtgtgacacatcctgtgaaccagactatctgccccgagagaaaaggacactaagagcctcctttggcatgtgactgtcgggggctgagcttgattgtgtgtccaaacagctccctcctaatactatcctggaatgcacacgcgtgcgtgtggtatgtaaatgtgcatgtgtgtgcgcatgtgtgtggtgtgcatatgtgcatgtgtgtgtgcatgcatgtgatgtatgtgcatttgtgcgtgcatgcgtatgtgtggtgtgcatatgtgcatcgtgcatgtatgcatgtggtgtatgtgcatgtgtgtgtgcatgtatgtggggtatgtgcatatgcacgtgcgtgcgtgtggtgtgcacatgtgcatgcatgtgtggtgtatgttcatatgcacgtgcatgcatgcatgtggtatgagcatgtgcatgtatgtgtgcatgcgtatggtgtgcatatgtgcatgtggtgtgtgcatatgtgtgtgcatgtggtgtgtaaatgcatatgtgcatgtgtgcagtgtgcatgcatgcgggtggtaggtaaatgtgcatgagtgtggtatatatgcatatatgtgtgcatgtgcgcttgtgtgcatatgtgcatgtgtgcatgtggtatgtaaatgtgcatgtgtgcatgtgtgcatgtggtgtatgtgcatatatgtgtgcatgcatgcttgcggtgtgcgtatgtgcacatgcgtgcatacatgtgggtgtgtgcatgtgcactggcatgtggtatgtgtgtatgagagacagagtgagccatcacagtttattataatcacctgctataatttttactccaacaaatgacaccataggtaatgattccttatgagatcatcagtgtcctttccaaagagtccctggttttccatcccagccattcacaaatgacacttccctggcctgggtcagaggaggatttccaggtggaagctccttattcctcctggctttgggcctaggactgttcatctgccagagagagaactgccatctgggggttgggtgtggaagtggcgtacaagctgtagaccctacagggaagggcagaacgtgggccagcctggaacacagcccactgttcctttggccacccaaagaaacatcctcactcagaccctttgcagactcaccagtcagagtgctcttattaatgcaaagttggccttgcgggcacaggggctgccagcacacagtaatttccatctcggctcctccacacaccctgtgctaggccactgcctgccactccaggccccagtggctgattctgcccctgtctccttggttcctctgcagacttctgaagctgttgtcaaggtggatgtggtgagtgtgggggccatgcaggggctctggggtgagagggtcctttattggcaatgatgtcaggccaaagggtccagcatcagggacagagccagccccagcccccgcatgcttgggccagcacacctcccctaagatgcagtggaaaagagctgggtgagtgcaggactcggtgccagtcctgcttgggcgagtggatcgcactggcaggtcacaacactctgtggcctgtggcaccttctccataaaataaggccctgccccttggacatgggtggccccacagagcctcatggagcccaaggcttcctgctgacagatggcggaatgggtggaggctctcgggattgtccaggcaggaggagtccatgtaggactctggacctggccaacctgcaggctgaggaggagaaggagaagaagaagaagaagaagggcactgcggaggagccagaggaggaggagccagacgagagcatgctggactggtggtccaagtactttgcctccattgacaccatgaaggaggtgagacctcgggtagggtgaggggaggtgaccccctccacactcagaccctcctgtccagcttctttcccacggcccccaagagctggatcccaactccattcatgtgagtttgggatggttttgtctcacatccttgaaatcctagctcagaactcaccttccaagatgatggtcccatctaccttccctgcttggttttcttttgtcctcattgactcattccacaaatgcctcttgggtatatgcgatgagccaggctccatactaggtgctatgggagccaaaagatgccacacctgccctgatgggcctccggtttactgggcaaaatggacatgtaaacagagacttagagaggactatgtgataacaaaggcaaatcatggcttgggggaatcagggaaggcgtctcagaggaggtgacctttgtggaaaaggagaaacatgttctcagaggccataagggaacaactgcttatcagtagtccttacgactcttcttcataatgttttattttacacatcttggtcatcggcacgtgaatgattcttcccctattacacatatgtgggttccatctgtttggccagattgcaagttccagaaagcgcatttctctgctttcttgtttgtgtcctctccacgctgcctacctagctcagggtgctctgactggccacctgaccaggagggacacatgcctgcagttgtgtttcctcagtggggccagagctgatccagccacatcctctcccaggccctttctgtgacccaagctaggtgtgatatttattagagcacacattaagctgctgtagcaagttagagtgaagtgaacaagacagcagtttatttctcacataacatctcagagagtgggggttaggctggtatggtggctcagtggtgtcaaggactaagatcctgacctcttgtttgtcacatctgtaaggttggaggtgactcaacatcatgttctaattcaagtgcacaggaagggttaaagaggagatgaggcatatgcttttctttttcagggcccaatccagaagctgcacatatgacttccactcacattgatcagaatctagtcccttagctacacttatctgcaaaggaggctgggaaatgtaatctttcacaaggtggctgtgtgctcagcaaaacttgtaaaaataggagaacagatcattgaggacaactggtagtctcgtctcccaccatcaagttggccaggctggagctgcaagaggctgcctgttgtcgtctctactcctgcaattttcacagactgccaccaggtggcggtggcgacttagttgaaacctggtttctagtttctagtaagatttattctcgtttccagtaagatggggtgtgctgagtgaaagaaaatatagtacattttcttactgttatacttttgtacattaaaacaatttattaatatcactaaaagcaacattaaaatgcactgtacttttttaagtagaaaatgtaaatatttattgcaaggtgttatttcttttttttttaaattatactttaagttctagggtacatgtgcacaatgtgcaggtttgttacatatgtatgcatgtgccatgttggtgtgctacacccattaactcgtcatttacagtgggtattgctcctaatgctatccctcccctctcccccagcaccaccacaggccccggtgtgtgatgttcccctccctgtgtccaagtgttctcattgttcagttccctcccatgagtgagaacatgcagtgtttggttttctgtccttgtgacagtttcttcagaatgatggtttctggcttcatccatgtccctgcaaaggacatgaactcatccttttttatggctgcatagtattccatggtgtatatgtgccacagatgcataaacccctaagtaccactagtcacactgtacacattataaactttttttaacccacttaagcagagcacatggtggacttgaaatgcagtagggaagattttctacttctagtgcattaagactggtctgggcccacaatttggggtcaacagactcctccccaggaaacccaccttctgtccttttcatctcatcttttggcagcaacttcgacaacaagagccctctggaattgacttggaggagaaggaggaagtggacaataccgagggtgagccctggaacctggaactctgcctcctcctccccgcccctgggtggtcagctctcctgcccacctcatcacctgcttctcttttccctcctgccagccctcccagccttagtagccagggaagcagcatcagtaatccatgggcagtactgggcaggctaaggcccttgtccagggaggcttttactctgaccagttcagcacccacagtgatgggcagacatttagagccacagaacatcagagctagaagggacctcagagctcattccatccagcattttccagactcttttccatgaagaaaattgatggatgttctagaaggaacaaattagttttggtcaaattagtttaggaaaagctgattgaaacagcttgttttggtgcaggacttttcataccctttactgtgcaaatgttattatacatctctaaaaggaagacacagtataaaatatttccccagcttattggatcacagtaccctttcttctaaagcatgccagcagcatctgcaccaggtgctccactgaatgaggtttgggaaatgctaatacagagtgttattattatggacaagaagagggaagctagtgaggaaagtgagtgggcaaggaactgcgcagcaacaggcctccacccccaaacccatgctccttcctgcccctctcttccaaagggcatgaagacagtcttcagacaccttcccgggcataaacccactggggcccccagcacctccatgaggcgggcatgctagggagtattatctgcatttgacagcacatggacatccgagagttaagttagtaaagcaaattagcgacagagctgggtctcgaatccaggccttcctgctctgctcatttctgctccacctccttttctgcttctggccaggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtgagagcctaggagcagacccttctagggtgtgtgggggcgggaagaggggggcgcagtgatcctgcaggtggggcaggacaaaagccagagaccaggcagccgccccctaacagcctggtctgtctcaggtataccccaaagagctggagtccgagtttgataactttgaggactggctgcacactttcaacttgcttcggggcaagaccggggatgatgaggatggctccaccgaggaggagcgcattgtgggacgcttcaaggtcaggccaggagcacgggcccagcctgagcacccgccagcccttgccccccccacaggttcccccactcacctcccaccactgccccggccactgcctccagaagccctggactctcccatgactcagcagttaaagggtgaaggccctgccacatcagggtccagccctcctggtgctgttagctattttgaatgccacccttgccaggcaaacctacaccctgacccacatttgtcttgcccagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggtgagactcccgtcgctttccctccttgcaagtctcctcatcctcccatctgggagagagcaaagaagctgcatactggccaggtgcaatggtttacgcctgtaatcccagcactttgggaggccaaggcaggaggatcacctgaggtcaggagttcgagaccagcctggccaacatggttaaaccccgtctctactaaaaatacaaaaattagccaggcacagtgccacgcacctgtaatcccagctactgaggaggctgaggcaggaaaatcgcttgaacctgggaggtggagcttgcagtgagctgagatcacgtcattgcactccagcctgggagacagagcgagactctgtctcaaaggaaaaaaaaaagaagaagaagctgcatactgacagccccagactgggaggcaccagggagatcatttggtctagtctttatcttttctagaggaagaagtcaacgcccagagaggggtagccacttgcctagggtcacacagcaagcctcctgaggggtccagtgctcctgcccctgcccttcactgtcataggaccctcaggcagcctggcaggggcactgaagatgagcagggcatgggagcctgctcaggcagcccttctccccattccaggccacggacctgcaccctgctgacatcaacggcaaagctgacccctacatcgccatccggctaggcaagactgacatccgcgacaaggagaactacatctccaagcagctcaaccctgtctttgggaagtaaggcttcttggtgccctcccctgccacacccctacttctccaacccagaacacctcccaccctagccaatccttaagcccttctcctaactccaccccaccaggtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacgtatgtggggcatggggcagagggcgggggcagtgtgcctgctttgcctccactctaaaatgagattcagatcctggtgatttgagaggttagacattgtggtttctgtcccaggccaggcctctgcccctacagtccctgggcacagtcttcaggggacaggactgcagatcccaaaacaaggagagggacagtggattccaggacagaggaggcaggacgaggagagacaagtgggctagggaaggtgggggctagcaagaggaggacagaaagagtcccctggggatctgggccagctctgccacttataggctgtgtgaccctggccaagtcccttcacctctctggttttcagtttcctcatgggagtctctgaggttccagaggagtgggcacagtgaggggatgcagtggggctaggctggggacactgatatgtggtccaaggcccagggcaggaaggttcagcctccagcagccctagtgtctcaggtgagcctggggcccagggcaggaggaatcaggctcacttgctgatgagggcaacagccaactttagagaactggccacgaccagctgtcatccaggatggcttagtcccacccagcccctccaagcctgtgtgtcccctcccacagacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtaatggggcactggatgcagccgcctgccccctctccagggggtttcagaggccaggaggggcccacacttccctggggaacctcacagcctagcctggggtgtcctcagcctaaacctggtcttagtgaccctctgctcatcaccccagagccccgttcctgtctgcccagcctctgtgcttccacccctcctacagggcagccccacctgctttctctctgtccaaatcccagtgaggtagagaggctatctgcatcccattctgcagataaacaaaccaagatcctacttctagtgactcgcccaaggtcatgtggctctttagaggcagagcgagggcatcggcccaggtccatctggctctaatccttaaactctccttacttctctgtccatgaggcacttcccagagaagcagagaattgggaggtgtctgtgctggtatctgatcactttcaggtgctgggacaggaagtggattctcccctccctgacccttctctcagcccagcagggctctccagtcaacttccccaagcagaggaccaagggcacagacctctcttggccctgtggggcagctgagaccctgggcaagccacttctccttctgtgcctcagtttccccaacagtgaaaaggaggtggggtagacaggtgatggcatagaggcttctttgtgctcctaagtccctagtcccagcaaaggtcttctggttctgctgagccatgtgtgcagctgagccgccggcacccacaggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcaggtgacacttgcatggccaagactggggttcttgggtattggggaccagggatccccaacctgagtcagtaaaggtagaagccaggcctcacgctgtccgctgcattccagaaagcctggcaggcaccttcccaccaaggcccctcagggtaacttgaatggcaagggtctttgctttgagtgagaattacatcagctcaggcagagacctgggttgtctccctcagaagctgtgattggctattggtgacatcataggaattcctggcatccaaagatggaaactgatgaactgggtccttgacagaacaaaggttaggagggagaggagagctgatcttcctgggcagagggagaaggccctgggagatctgccacaaccctcttcctcagggccgcctggagctgtgggtggacatgttccccatggacatgccagcccctgggacgcctctggacatctcacctcggaagcccaagaagtgagcggcctggggcccagcgctactcccttccggcccaccccacccacttcccaccacggcccaacccttcctgcggggggctcaggtccagatggccttggccagttggcatccctggggcctgggtgtggccactgggccttataggggagaaactgaccaaccaatcgatagagtttagggcctgccctggagagtccccacgtgctaaggcaggacaacgccttccaccctgcatcagtgagcgagacaagccccacacagcacactccggtgcattgtatctacacggtctacgcgcccatacacatgcatctcatgcacacacacacacacagcatagcactcccacggacacccacacacatgcccacactgacgcactccttcacaacacacagaacccctgggagccggccctgcgtcatcctcacatccaggctagtgtgatgttccgccaagttttctttggagtgcctgccagtgatgaatccaggagtgagtgcctggaagaggcaggaggtggtagagtgaaaagaacccgggtttcccatccataaagcggcaggttcaagtccagctgtcagacagtgactggattcagggccagcttcagggatggaggaagccacacagggtcccactcttgtttccatgctcctatgttgccatcttgaaattctttatgacaagtgaccctgcatttccatttggcgctggccccagcaaatcatgcagcaaattctgccaggaatgtcctggaaacctgaggccatgagtcagctgttccagggcctgtcattagggggcacccaactcactgggccactctgggctcgcagccctgtctgcaatcccaggagagccatgctcagatcaatttttagtgaatgactcagcctcactcttaatgattgaaatgaactacatcattcataattacaattaaaccttgaggggaaaatcctctttggggacagggacatacagcttccatgggcttccattgctggctactgggcttaaatgcagacttctcttggaactagcatctgagacagagggtggcttcctcccctcaccccacccccaccgcccacagccatgtgcctggtgggccttctcactcatgcctctgctcccccaaccccaaaccactcctccagccccagcctggcccaggccctgtgctgaccccaagaccccagggcttctctccgcctgccccatcccagccctggcaccctggcataacccccacctggggctgctaaccagccttctctccctgggcccaggtacgagctgcgggtcatcatctggaacacagatgaggtggtcttggaggacgacgacttcttcacaggggagaagtccagtgacatcttcgtgagggggtgggtgagcagtccctgcatgggagggactgagctgggtggggcttgcttcccggggggcaggagaggaggcagagggaaggtggctgtgggtgggagaggccccaccagcctggctgcgggtctggagatgtggcgcccacaggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggtgcagagcagggcagggatgggggttcaggatccagaactgagaagaggcaggggccgggttggcggggacagggagagccctgccttggggggacaaggggtcattgcttccagtccatcagagccaggggtgtccgacggggttccgcccccaaggacccacctaaccgtccctaggcagatgttctcagtgtcataaccaggctgacaacaagctttggacacaccaaggagggggcagtcagtgatgatgggggaggggagaggctccctaagggagtcgggaaacctccctgggcctcaggttgcttctctgtaaagcagggattctccctaaaactctaatctgcatctgcaaaagcttgtgggattagcaggactttgacagaatggatgcatggcagggagtggcaggggagaccccaggagagaccctctggggtgaaagaaggacctgagtaaagcatgggggctggggctgcctagcaagcccacgaggatgcctgcattgaggccagttgctgggagtgaggcaggaggatgagatgtgggctcagggaggtctgcactcagcaaacaaggggccgaggagcccagacccccacccccaccccgccccaccccagccctgttcactctgagctgacactgaggttgccacaggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacggtgcgcaccccttcctgctcgggcagtaggcagggctgggactggctggggtgccaagggcccagcacgcagcctggacgctgggacctgtctgtcctctgcagggcaaggtggaggctgagctgcatttactgacagcagaggaggcagagaagaacccagtgggcctggcccgcaatgaacctgaccccctagagaaacccaagtgagtgccctgccggcccagcccctccccactctggctcttggaggcgctggaacaggaaggagacgatccccagacaccccatctcttcctgggccacagcctcattacaggggagcctcctccctgccctctgccaaccctgaatcccacaacgtccctttgaaccagaggatgggctaggaatactggagagcaggaccttccctgggaaaggccccatctagcggagagaaactatgctcttcccttcctagcttttgcagaagagccagctccagtggtggcctctggggccatggccagccttgatggccagaggggtgcctagaactgcacacacagcccaggacagcttccctcttggtcttggcccctcgccacacccaatcccttctcctccctgtccctcctctgcgctctctacccttcatactccagccggcccgacacgagcttcatctggttcctgaaccctctcaagtcggctcgctacttcttgtggcacacgtatcgctggctgctcctcaaactgttgctgctcctgctgctgctcctcctcctcgccctgttcctctactctgtgcctggctacctggtcaagaaaatcctcggggcctgagcccagtggcctcctgggtctgatatttcttacttcttcctctggaccaagggctaggcaggcgcgtgcacacacacacatatacacgcacacatccacaaacacaaatatgcatacatgtgcacacaaacacacacaagcatgtatgcacacatgtgccacgcacaagtgcatacacatgcactcaagcacacacaggcacacacttaagcccacacaaacatgcacagcaactttcaagctttcatgacagaatagactctcagaactagaaatgactattttacacttttccacattaagccaaagaggtgaagtagcttgctcaaggttacccagcaaattagggtagagccgggactcaagccaaggtttccaaatttccaatcctgtgttctttgcacaccacctctgctcccagccatgtttctcccagactgtaacccaattttttttttttttttttttttttggagacagagtctcgctctgtcgcccaggctagagtgcagtggcacaatcttggctcactgccagctccgcctcccgggttcacgccattctcctgcctcagcctcctgagtagctgggactacaggcacccgccaccacgcctggataattttttgtatttttagtagagacggggtttcactgtgttagccaggatggtctcgatctcctgacctcgtgatccgcccatctcggcctcccaaagtgctgggattacaggcgtgagccaccgcgcccagccgactctaacccaatttcattggcagaaagaagctgagctatggacagggaaaagggaagggtgtggccagggttagccaacaggtctggaaatggctctcacccgtgtgtgacctcccagtccagggctgttgttttctgcccttcaggataataattccattcaactcaaacatttcatagccaccatggcctgaacacccaactgcaggtgctcagagctccccaggcactggctcactgtgccattgcgccaaacccaggaggtaggtactgcttgtaaccccattttatacatgaagaaaccgaggttgatagaggtgcctcacttgcctgtgaaaaccattcaaaaccaggtgccctgcacccaagccccggctctgtgtccccaccaatactgagctcagctctggggctgcacgccatgtcctctgggaggcagtagtttgaaaatgcatatgcagtactttcacttgtatcttgacattttacaaaacctattgtttttataacacaaacgacagatagtgaggctggccaggtgcttctcggctgggaggctctacagaaggtggagtgggtcttcatcctgagagtgggcaggtcggtgagggcagcttgcaccccacaggggctgctcagaccctcagcagggcccggtgggaacagccatttatgtccatcagaaaggaagaggttgtgaagcaccagtcttaccaaggacgtggggcagcacatagaacgagctaaccgcaggagcttcctaacgatgagaactgcctgcagggccaaggctgccccatgctgcaagtagctcccatctaggccttaggaggagattcgggccccaaaggtgctgcagggaggatagagttttgtaagcagcaagtcgggtacttagaaatgggtttaaaccctggctccagcattcactgcttttggggctggggccatggcagggcttttgggggtccagaaggacagaggatggggtgcactgggaggcagctcctgcccactggctgaccggctcctctcttccacttcccagccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctcccgccagccgctccccagccctgccgcatttcctttcagtggcttggactctttcccatctcccctggggagcctgaggagcccagcgtccactcttcatgccttgggccgagcctgcctcctgcttgcgggggccgcctgtcctcactgccccaggctgcggcttgcccagtcccgcccctctgacccctgcctgtgggctggggagccttggatggggtggggacctggaatgggtctctcttgccccacctggctgaggcgccacccttcttcaggcccaggctccagaggaagactcctgaaaccctccccaggtcttccaagtacaggattgaagctttagtgaaattaaccaaggaccatgggtcagtgcccagggctttaaaaagaatgaacgagcaaaaggtatccccgccgtgacccctgcagatagcaccggtctttgatccgcagcaggggccagaccctgcccacaagtcccagcgcggctgcttctgccactgctgggctccacttggctcctctcacttcccagggggtcgcctgtcctgcctgtgggtttccatggcttcccagagctccctctgccccagccagcgcctccaggcccagctgaggagctgtgagaagcagcagaggggactccccatcccgggcacaccctgtcctcccacccctgcccccttgcccttccagccctttcagctgcagctgggagctggcccgtcaagtgctgcccctgcctgtgtctgggtttctgttggctgtttttcttttcttgagtggtgatttttctctaaataaaagaagtcaagcactgagctgacaggtctgcactggtcaagctgagaggagcagccgcaggtgcggggcagaggcagcagttctctaggctggcagattcagtaccagcagggctcccatggcctttccccttcaagtggcctctggtggcccagggttcaaggcaggcctcaggcacagggctgcccacccaggctgcccacaggaggagtcttacaccatagcccaaagggcacaccagcctgggcccaggggcccccaaagcaccgaaagaatccttcaggtctggggccagtctgaaggcttaaggccccacaagggcccaaaagctctagcctccacccacagaaaccagttcccctgaaagcaagaaaggagccccacgctactggcctcggcctctgactcacaccactatctgagcctggggcaaagtcccctcatgacacagaggtaggggcaagggcctggtcttgctagacctgacctctttaaagagattcagccacaactttaaaaggctttaatcataatgcaggacacaggtaactcctctggctccttatttcgacaggctataaagacagccctggaaaatccagagagcaggcccaggtgcggcccagtgggtgatatgagctggctccggcacagacaccagcatcaggccagccctaacacatcagcctttggcggtccagctcattttgtgggtacccgcaacacctgagtgggaggaacttgcagttcagagttgatctggaaaagaaagggtgaaagtcgttacatttttcccagggccctccttctttgccacccttgcgagccacgctggctctcccatgggcctccaaagccctgcacgcatctcctctccaaagctgagagatgctgaacacccacagactgcctccctgcaggagacacgcctgagccttcttgctcagcttctgctccagctgtgacctctggtagcgttcttcatctcccgcccgtccattctctgcagtcttcccctctcctctctccacgcacccatgccatccccaatctagcctgccccacctcttcctcccccagcctcttgtatacagtagcatctgtggaagcgggaaccataccgtccagaatgtctgggtcctgtcacaggccaagggtcattatgaggccaaggttcactacaacatcccactttcagctgtggcctgggacctgggactgtgctggggccacgcagcccctgtggctggacttggagctggcctcagtcacctcacacgtgtgcaactaacagctgcgtcacgaccttcctggcctacagccccagctgcaggtgcccacacccgcagagcaggaaatgtcagcaatggactttttccttcctcctcttgccaggccatggggaagttgtccacaactattgcagggttgggcacagatgggggccagggaatatctgccccagcagagcctccttccccatgcgaggatgaccctccagtcatatcccaggcagggaaccggggctggtgggtggaaagagcccaggctctggacgagttgcaaactctgcaagttgtgattgtcctttgtgtgaaatgaggagcattgtttccgccctgtccacctcacacagcgggtgtgaggatggaagaagagagcacagctggaggctctgtagctggggagctgctcctggctgtggcactgcttcacacagagcagtcccagctggccactggcaccagaaaccacagtatcaaagagacactgtcacacctgagctgtcctggaggagacttcaggcaagatctactcctttggccagtagttgtctcaaggtgccactcttgattttttacatcatatcacaaagctcccttgcctctgacggggaggggactcctcgttccctaatcccagctccagtgcccctgccccacccgtgtctcccgctgcccctccttggaaggccccgccgcccaccttggagttcagatactgctgcagtagcgcc

SEQ ID NO: 13 - protein, 1977 aa, Mus musculus
MALIVHLKTVSELRGKGDRIAKVTFRGQSFYSRVLENCEGVADFDETFRWPVASSIDRNEVLEIQIFNYSKVFSNKLIGTFCMVLQKVVEENRVEVTDTLMDDSNAIIKTSLSMEVRYQATDGTVGPWDDGDFLGDESLQEEKDSQETDGLLPGSRPSTRISGEKSFRRAGRSVFSAMKLGKTRSHKEEPQRQDEPAVLEMEDLDHLAIQLGDGLDPDSVSLASVTALTSNVSNKRSKPDIKMEPSAGRPMDYQVSITVIEARQLVGLNMDPVVCVEVGDDKKYTSMKESTNCPYYNEYFVFDFHVSPDVMFDKIIKISVIHSKNLLRSGTLVGSFKMDVGTVYSQPEHQFHHKWAILSDPDDISAGLKGYVKCDVAVVGKGDNIKTPHKANETDEDDIEGNLLLPEGVPPERQWARFYVKIYRAEGLPRMNTSLMANVKKAFIGENKDLVDPYVQVFFAGQKGKTSVQKSSYEPLWNEQVVFTDLFPPLCKRMKVQIRDSDKVNDVAIGTHFIDLRKISNDGDKGFLPTLGPAWVNMYGSTRNYTLLDEHQDLNEGLGEGVSFRARLMLGLAVEILDTSNPELTSSTEVQVEQATPVSESCTGRMEEFFLFGAFLEASMIDRKNGDKPITFEVTIGNYGNEVDGMSRPLRPRPRKEPGDEEEVDLIQNSSDDEGDEAGDLASVSSTPPMRPQITDRNYFHLPYLERKPCIYIKSWWPDQRRRLYNANIMDHIADKLEEGLNDVQEMIKTEKSYPERRLRGVLEELSCGCHRFLSLSDKDQGRSSRTRLDRERLKSCMRELESMGQQAKSLRAQVKRHTVRDKLRSCQNFLQKLRFLADEPQHSIPDVFIWMMSNNKRIAYARVPSKDLLFSIVEEELGKDCAKVKTLFLKLPGKRGFGSAGWTVQAKLELYLWLGLSKQRKDFLCGLPCGFEEVKAAQGLGLHSFPPISLVYTKKQAFQLRAHMYQARSLFAADSSGLSDPFARVFFINQSQCTEVLNETLCPTWDQMLVFDNLELYGEAHELRDDPPIIVIEIYDQDSMGKADFMGRTFAKPLVKMADEAYCPPRFPPQLEYYQIYRGSATAGDLLAAFELLQIGPSGKADLPPINGPVDMDRGPIMPVPVGIRPVLSKYRVEVLFWGLRDLKRVNLAQVDRPRVDIECAGKGVQSSLIHNYKKNPNFNTLVKWFEVDLPENELLHPPLNIRVVDCRAFGRYTLVGSHAVSSLRRFIYRPPDRSAPNWNTTGEVVVSMEPEEPVKKLETMVKLDATSDAVVKVDVAEDEKERKKKKKKGPSEEPEEEEPDESMLDWWSKYFASIDTMKEQLRQHETSGTDLEEKEEMESAEGLKGPMKSKEKSRAAKEEKKKKNQSPGPGQGSEAPEKKKAKIDELKVYPKELESEFDSFEDWLHTFNLLRGKTGDDEDGSTEEERIVGRFKGSLCVYKVPLPEDVSREAGYDPTYGMFQGIPSNDPINVLVRIYVVRATDLHPADINGKADPYIAIKLGKTDIRDKENYISKQLNPVFGKSFDIEASFPMESMLTVAVYDWDLVGTDDLIGETKIDLENRFYSKHRATCGIAQTYSIHGYNIWRDPMKPSQILTRLCKEGKVDGPHFGPHGRVRVANRVFTGPSEIEDENGQRKPTDEHVALSALRHWEDIPRVGCRLVPEHVETRPLLNPDKPGIEQGRLELWVDMFPMDMPAPGTPLDISPRKPKKYELRVIVWNTDEVVLEDDDFFTGEKSSDIFVRGWLKGQQEDKQDTDVHYHSLTGEGNFNWRYLFPFDYLAAEEKIVMSKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTAFVWFLNPLKSIKYLICTRYKWLIIKIVLALLGLLMLALFLYSLPGYMVKKLLGA

SEQ ID NO: 14 - DNA, 6862 bp, Mus musculus
  source 1..6862: mol_type = genomic DNA
ttggttgccttggtctctgtgggcagcagcaggaggaggcggcagcagccagagaagagggaggcgtgtgagccacactccaccagcgagcttcttcccgctgctctggaactgcccaggctctccccaccagcatggccctgattgttcacctcaagactgtctcagagctccgaggcaaaggtgaccggattgccaaagtcactttccgagggcagtctttctactcccgggtcctggagaactgcgagggtgtggctgactttgatgagacgttccggtggccagtggccagcagcatcgaccggaatgaagtgttggagattcagattttcaactacagcaaagtcttcagcaacaagctgatagggaccttctgcatggtgctgcagaaagtggtggaggagaatcgggtagaggtgaccgacacgctgatggatgacagcaatgctatcatcaagaccagcctgagcatggaggtccggtatcaggccacagatggcactgtgggcccctgggatgatggagacttcctgggagatgaatccctccaggaggagaaggacagccaggagacagatgggctgctacctggttcccgacccagcacccggatatctggcgagaagagctttcgcagagcgggaaggagtgtgttctcggccatgaaactcggcaaaactcggtcccacaaagaggagccccaaagacaagatgagccagcagtgctggagatggaggacctggaccacctagccattcagctgggggatgggctggatcctgactccgtgtctctagcctcggtcaccgctctcaccagcaatgtctccaacaaacggtctaagccagatattaagatggagcccagtgctggaaggcccatggattaccaggtcagcatcacagtgattgaggctcggcagctggtgggcttgaacatggaccctgtggtgtgtgtggaggtgggtgatgacaagaaatacacgtcaatgaaggagtccacaaactgcccttactacaacgagtactttgtcttcgacttccatgtctctcctgatgtcatgtttgacaagatcatcaagatctcggttatccattctaagaacctgcttcggagcggcaccctggtgggttccttcaaaatggatgtggggactgtgtattcccagcctgaacaccagttccatcacaaatgggccatcctgtcagaccccgatgacatctctgctgggttgaagggttatgtaaagtgtgatgtcgctgtggtgggcaagggagacaacatcaagacaccccacaaggccaacgagacggatgaggacgacattgaagggaacttgctgctccccgagggcgtgccccccgaacggcagtgggcacggttctatgtgaaaatttaccgagcagagggactgccccggatgaacacaagcctcatggccaacgtgaagaaggcgttcatcggtgagaacaaggacctcgtcgacccctatgtgcaagtcttctttgctggacaaaagggcaaaacatcagtgcagaagagcagctatgagccgctatggaatgagcaggtcgtcttcacagacttgttccccccactctgcaaacgcatgaaggtgcagatccgggactctgacaaggtcaatgatgtggccatcggcacccacttcatcgacctgcgcaagatttccaacgatggagacaaaggcttcctgcctaccctcggtccagcctgggtgaacatgtacggctccacgcgcaactacacactgctggacgagcaccaggacttgaatgaaggcctgggggagggtgtgtccttccgggcccgcctcatgttgggactagctgtggagatcctggacacctccaacccagagctcaccagctccacggaggtgcaggtggagcaggccacgcctgtctcggagagctgcacagggagaatggaagaattttttctatttggagccttcttggaagcctcaatgattgaccggaaaaatggggacaagccaattacctttgaggtgaccataggaaactacggcaatgaagtcgatggtatgtcccggcccctgaggcctcggccccggaaagagcctggggatgaagaagaggtagacctgattcagaactccagtgacgatgaaggtgacgaagccggggacctggcctcggtgtcctccaccccacctatgcggccccagatcacggacaggaactatttccacctgccctacctggagcgcaagccctgcatctatatcaagagctggtggcctgaccagaggcggcgcctctacaatgccaacatcatggatcacattgctgacaagctggaagaaggcctgaatgatgtacaggagatgatcaaaacggagaagtcctacccggagcgccgcctgcggggtgtgctagaggaactcagctgtggctgccaccgcttcctctccctctcggacaaggaccagggccgctcgtcccgcaccaggctggatcgagagcgtcttaagtcctgtatgagggagttggagagcatgggacagcaggccaagagcctgagggctcaggtgaagcggcacactgttcgggacaagctgaggtcatgccagaactttctgcagaagctacgcttcctggcggatgagccccagcacagcattcctgatgtgttcatttggatgatgagcaacaacaaacgtatcgcctatgcccgcgtgccttccaaagacctgctcttctccatcgtggaggaggaactgggcaaggactgcgccaaagtcaagaccctcttcctgaagctgccagggaagaggggcttcggctcggcaggctggacagtacaggccaagctggagctctacctgtggctgggcctcagcaagcagcgaaaggacttcctgtgtggtctgccctgtggcttcgaggaggtcaaggcagcccaaggcctgggcctgcattcctttccgcccatcagcctagtctacaccaagaagcaagccttccagctccgagcacacatgtatcaggcccgaagcctctttgctgctgacagcagtgggctctctgatccctttgcccgtgtcttcttcatcaaccagagccaatgcactgaggttctaaacgagacactgtgtcccacctgggaccagatgctggtatttgacaacctggagctgtacggtgaagctcacgagttacgagatgatccccccatcattgtcattgaaatctacgaccaggacagcatgggcaaagccgacttcatgggccggaccttcgccaagcccctggtgaagatggcagatgaagcatactgcccacctcgcttcccgccgcagcttgagtactaccagatctaccgaggcagtgccactgccggagacctactggctgccttcgagctgctgcagattgggccatcagggaaggctgacctgccacccatcaatggcccagtggacatggacagagggcccatcatgcctgtgcccgtgggaatccggccagtgctcagcaagtaccgagtggaggtgctgttctggggcctgagggacctaaagagggtgaacctggcccaggtggaccgaccacgggtggacatcgagtgtgcaggaaagggggtacaatcctccctgattcacaattataagaagaaccccaacttcaacacgctggtcaagtggtttgaagtggacctcccggagaatgagctcctgcacccacccttgaacatccgagtggtagattgccgggcctttggacgatacaccctggtgggttcccacgcagtcagctcactgaggcgcttcatctaccgacctccagaccgctcagcccccaactggaacaccacaggggaggttgtagtaagcatggagcctgaggagccagttaagaagctggagaccatggtgaaactggatgcgacttctgatgctgtggtcaaggtggatgtggctgaagatgagaaggaaaggaagaagaagaaaaagaaaggcccgtcagaggagccagaggaggaagagcccgatgagagcatgctggattggtggtccaagtacttcgcctccatcgacacaatgaaggagcaacttcgacaacatgagacctctggaactgacttggaagagaaggaagagatggaaagcgctgagggcctgaagggaccaatgaagagcaaggagaagtccagagctgcaaaggaggagaaaaagaagaaaaaccagagccctggccctggccagggatcggaggctcctgagaagaagaaagccaagatcgatgagcttaaggtgtaccccaaggagctggaatcggagtttgacagctttgaggactggctgcacaccttcaacctgttgaggggcaagacgggagatgatgaggatggctccacagaggaggagcgcatagtaggccgattcaagggctccctctgtgtgtacaaagtgccactcccagaagatgtatctcgagaagctggctatgatcccacctatggaatgttccagggcatcccaagcaatgaccccatcaatgtgctggtccgaatctatgtggtccgggccacagacctgcacccggccgacatcaatggcaaagctgacccctatattgccatcaagttaggcaagaccgacatccgagacaaggagaactacatctccaagcagctcaaccctgtgtttgggaagtcctttgacattgaggcctccttccccatggagtccatgttgacagtggccgtgtacgactgggatctggtgggcactgatgacctcatcggagaaaccaagattgacctggaaaaccgcttctacagcaagcatcgcgccacctgcggcatcgcacagacctattccatacatggctacaatatctggagggaccccatgaagcccagccagatcctgacacgcctctgtaaagagggcaaagtggacggcccccactttggtccccatgggagagtgagggttgccaaccgtgtcttcacggggccttcagaaatagaggatgagaatggtcagaggaagcccacagatgagcacgtggcactgtctgctctgagacactgggaggacatcccccgggtgggctgccgccttgtgccggaacacgtggagaccaggccgctgctcaaccctgacaagccaggcattgagcagggccgcctggagctgtgggtggacatgttccccatggacatgccagcccctgggacacctctggatatatcccccaggaaacccaagaagtacgagctgcgggtcatcgtgtggaacacagacgaggtggtcctggaagacgatgatttcttcacgggagagaagtccagtgacatttttgtgagggggtggctgaagggccagcaggaggacaaacaggacacagatgtccactatcactccctcacgggggagggcaacttcaactggagatacctcttccccttcgactacctagcggccgaagagaagatcgttatgtccaaaaaggagtctatgttctcctgggatgagacggagtacaagatccctgcgcggctcaccctgcagatctgggacgctgaccacttctcggctgacgacttcctgggggctatcgagctggacctgaaccggttcccgaggggcgctaagacagccaagcagtgcaccatggagatggccaccggggaggtggacgtacccctggtttccatctttaaacagaaacgtgtcaaaggctggtggcccctcctggcccgcaatgagaatgatgagtttgagctcacaggcaaagtggaggcggagctacacctactcacggcagaggaggcagagaagaaccctgtgggcctggctcgcaatgaacctgatcccctagaaaaacccaaccggcctgacacggcattcgtctggttcctgaacccactcaaatctatcaagtacctcatctgcacccggtacaagtggctgatcatcaagatcgtgctggcgctgctggggctgctcatgctggccctcttcctttacagcctcccaggctacatggtcaagaagctcctaggggcctgaagtgtgccccaccccagcccgctccagcatccctccaggggctgctgcgtattttgccttccctcacctggactctctcccaactccctgaggagccctcccacgcctgccagccttgagcaagacacctgcttgctggacttcatccccaccccacacccaaactgttgcttgcctgatcttgtcccaggcctgcctggggtttggggcacagttggcctccaaaaccagataccctcttgtctaaagtaccaggttcctctgcccaaccccaagagtggtagtggcccaaccctccctgtgctttccaaatcttgtcttaaggcaccagtgaaattaaccaagaaacgcggagcaatgcccaaggctctgatgagtaggaacacgtggaaagcaccaggaatgccagcagaggcgaggcggcacacctctctgcagagcatccaggccgagcggcgggcagcggccagctgcttctgcgcatgctctcctcttggctctgcttctttctcacagtcacagtcacttcacagcttagccttgggcttcccatcacttccaggggtgcctctgccttggccagtgtgtgtcagctagtacacaagctccaagtgtgaatcaggtgtactggccgtcctgaagactgactgccctgtccttcctgccgacagccacacccgagtgtacacttaaagcggtgcccttctgcctctgtgggcctgctggctgctgttcctttcttgagtgtgattttttttttctctccctcaataaaataaatcaaactctgagac

SEQ ID NO: 15 - DNA, 95665 bp, Mus musculus
  source 1..95665: mol_type = genomic DNA
gaagcctagggtcaacttcagttgtcttccttatttatttatctgacttgtttatttaaagacgggtctctttagcaaacctggagcttctccattcagatagctccgctgccattaaactccaggggttctcctgtctccacctttctgccaccgcagagctgggttagaagcccttgcccctgcaccggtctttaccatagactctggaatctaaactcagatcttcatgctcctgtggcagacactttacctactgaggcatctcctttgccctcggctgaggcacagcatgatttatccagagcagtcaggtctgtcccgtccatgatctccaagccttctgagcatccacaaccctggtgattagctagacacatcaagagacatcgtggatactgcccaagagaccagtgccccattcaagctcagacagtgaagttccagatccccatgagaagtggcctgacccctcatctgcccatctgcatgccctctgcaatctgttggctctgagtggcacagcttgctctgccctgccaagtggcaggagcttccattccaggagctggcaggagacacctgaagccggacagggctttatctcggagctggtgctgctgaataatggattcagcatgcgttcctgggctcctgcacacactcactcacacacacacacacacacacacacacacacacacacacacgcgcgctacacacatgctgggctgacaacccagaggggcggggctgccggggctgcacagctctgatgagctgaaggagcagcttgctttggttgccttggtctctgtgggcagcagcaggaggaggcggcagcagccagagaagagggaggcgtgtgagccacactccaccagcgagcttcttcccgctgctctggaactgcccaggctctccccaccagcatggccctgattgttcacctcaagactgtctcagagctccgaggcaaaggtgaccggattgccaaagtcactttccgaggtaaggtagcccctgtctcaggagggtgccagttctgcaagcaggctcagcccatattctgtgagctgatagggacgggagaggacaaggaggagggatggcactgtagctacaaggcttcttaagagtgcccacctgtccctggcctgactagcctttaagtttcatatgatccccgctaggccaacccgccagggtcctggcagagtacagattcttggcttaatgaggggtccatccctgtggtcacacagacccaggactaagggccccaggctagcaccttcctgggaccccttttctaccactactcccagactggcttctgtctgctgaaaaggagtctatgcctgaaaagaccagagtggctagtagaaaccatggcagccagtggtactctgccctccagcgtggtgaggatgctgttggcttttctagaccttctgtttctggacaggaacattattctgacctttcctctgtggactcctcttagctttcttcagcttgtatattatgacctattgtgtaccaaatctggagggctagaaatgtgaggatgagtgtaaggcaggccctgtcctaaagagccacatctggtggggtaggggaaacagttagcaggcaggcacaagtatgtgatgacaagcagaaggggacctgattatcctaaccaagactgggagcaagcagtcagagaaggcttccaggaggaggcaatgctcagctgctggctgagagatcagcagagggagcaagcaaagggaaggatggcgtgggggaattaggaacagtgatccccaaggctgggaacagagctggagaaaggagagacagaggctacgtgagctggagctcagagtggagacagaagctgggctccaaagagccaaggagctgaagctggacttcggccagggtatctggcagcccctaaggatcaagtagagaaacacaaggtcgggctcatctctgtgcccacccacccctgcaaaattcagcctgcctagccactttgaccagggtcaaggtgccattctcccatgtggcgccattcccacccccaggggtcacagggaaggaactatataacccaggatgtacactgtccctgaacgtctgccaggagggagctacgagacagggcaagtcagtagacatcccagtgggagtctccaggtgccctgtgtcacccactcaggccctgggctctctgcctgcaaccagctgttcacagagcaggtggaagttccagccatgtcttctggcaggagcaaggcaggcagaagtgaccagagagtgggctggaccacctactgcattgccggccaccccagtggctgctttttccgcagtagcctagctctttgtgtgccacctgctggcttgtgctggcttgtgctggctttagaacaagtacatccctgggttccacacacagccctgggcctgattcttagccctaggttacttggtggctacagttgtaacaccacagacccgaccaagcagggcctgtctccttcccaaaaagagaaaccagggtccagagagccgaccagtgagttagtgagggatagggacagtggcccaactgtcatggcttcatcctggccacccagtcctgtaatctcttctgtctcctccagggcccacaaggagtgggcatcctgaacaaaagagactcatagacttttttttctcttcgcagagggcagtgttaggaagttgaacccagggtctcccacatgctacataagctctcccctgctgaaccatgtgtgtacctcccctttccagtcttcagttcactctatagcccaggcacgcctggagcacacactcctcttgcctcagcctctacggtagctgagactacggcctgcccaccaggaccagcttttacctcttcctttgagctgccagggcaaacacccttgaatcaggctgtttgtaacccatgctctcctcatagtcagaggtagagcttttggggcaagaagtgaggggcgggcagtagcaacaagaaaaactgcagtcagatctccagagtgaatgctcagacattcccagcaggtggtaactatgggcacccccaaaacaacagctaacattgacatttcagagggaactgaccagcagtgcatgcctttcttacatctacagtccatgtttaaaccacactgcattgggggtaaattagaaaatagagctccctgcccccatctctccaaaaccctcaaatgaggccctcagcagatggggtggtgggccagcatgggagctaagggtgaaggagaggaaggtcctgccctgaggagctgcagggcaacaaagaggcatggactccaccctgcctcacccagcatggccggcctgggcctcccagcagcaaattggaaacagtcgccccactgcatggaggggcctcctgcctgcaggagctggctcaggagcaggacaggtgcagaatgcttgccggattccagtttctctgctcttacttcaactcaagtaatcaccagagccacagaacacagggtgggagctgtctgtctgtctgtcttctgccttgtgctcagcccctgtgacctccccagccctccgctgccagatcccagtggtagcttgtctctctacactcctcccctgagcgttcttgccacagcacaaggctgagaatcctccagacttccacttattcacctggcccgcctgctggtacggaggtcttctgtagcgaggcttcctgtggggtttcatctttacacccctccccacaccccagcttccgtcctactacactgaatgctgatccccaaggtgccaagggcgtcgcgcctgagactgtgtacttctttgttaaagaatggcccccattctccgccttacaaatgtccatcttgtgcgtacttcaaggctcactagtgtgccacctcctccaggaagtcttcccctcccttccacatcctgtacaccctcttgtagctctgccatagtttccccgtgggcacaggtcacactctgtgagctgtgctacctcctgaggaccctcaaggtagagagcagatctcagctgagctgctaagcagccaccataagaaattccctcgttctctgaggtctctagactttttgtttatttgttggtgttttgagacaggatctcatgtagcccaggctggccttgaactctctgaagctgaggatgacaggactacaaacacacagtaccatgtaccacacttttcactgttgaatgggcttaacgtcttcactgccactccttccctgtcactccttggcttagctcaactgtaaatgtctccagaacttggtgctataggatatacccagatgaaaagagatctcaggagccaagagctgagaacaccagctctatcaaccttccttctatcagccgctagctccgagaagcttcagggaccaggaggaaggctgacttcatccttcagcaaatgttgggggtggtctaacccagtccatgtcactcagagccccagcagtcagggagtgcttcctgtaaggggagggaaggttggcctagagaagcaggtcctagctgggtctggatgccatctctgcatacgtggatacaggacccttgaggatgggctgttggagacaaagctactctagatgagggagtggagtgggctcccagccagaacagctgggaagccagtaccgtggctagaggcaggaggatgggggtgagtgtgccctaaggacaagtgtaccctagaggccttgtttgcttgtttgttggtttgttttgtgactataacttctttctggaaccacctttgtcatcatccccagtaagggagtcagactatccaaggcccccatcctcagcatttccctgactgcctaggccatcctagcacctctgctcttggagaatggggcaggtgttcctcttctgaaggcagaagacagaggggctccctgagaacagcagctttagtccatgctggtgtgggcacagtgctgtgcttttgacatagctacaagattgcatcttcagcatccttccatccctccaacacacctgggggacacctggggacaccttcttgcctaaatcccagggtgtcgagagatcctccttttcttccttctccttccaccctcctccccttcctcttctcttccctcctcccactcccctcctcctcctcttcttccttcccctccttcccctcctttccctcctccttcccttcccctcctcctccctccttccccctctcctcctcctccccttcctcctcctcttcttcttcttcttcctcccccctttcccctgagtaagcccaagcagatgcagacctggtagggagcagatattccacccagaacgttccctaggccctcctgctttgatacgggaaggtactttcatgctatgaaaatgactgtaaaattatcttctgctacaaaggcacgcaatgaacactgctggaaatgtctggagagagccaacctgcaaacgattccccagagcaggaaggctcgcttatcacgtccatctctactggcaacaaaaaagctgccttctcctacctacacccactccatggtcagataaaaaatacaataaaaagcttcaaatatatacaagaggagggagcataatcgtttgcagttttgacaccctcagctcacggcccatcgtgttcatgatccccttctaattccctcacgccaattatactgggggggaaaaatccatcatttcatctagaaacagtcatagatatagaaaaaaaacacatatattttactgttccttaaaactgagcaatttccaggtactcagtccacgtcaggttccttcgtctcctcgatgttataatgttttccagctcatggaaagcttcttttaatgtgtcttgtgaatcaagtagttaatgatccattcacccagtctgtcatttatccacaaacagtatttgagagccatccatgtgccaaacattgctctagaccctggggaccctgtgccaaacattgctctagaccctggggaccctgaggggacagcaaagaggccctcgagggggaaggacagccctgaccccatcactgaacatgcagagaattgcagaggagaaggcacgggtgtcagggcagagcacagccagggaaacaggagattggcagccctgacaaggcaggacagaggcaggaggcagtacccatccagccaccctgcagccagaacgggtggggtctgggagggccggcaatggaagggggatatgctgccaggaagctgacccgagtgcaggtcagagaatcgcggcagggacgagcctacagaatagactagtgtggggctgggaagatgcctctatgggcaaagtgcttgctacacaagaattcagagctccagaaccccatgttcatgggaatacaaggtaggcttgcctgcaattccaccctgggacagcagaggcagagatccccagagcaagttagacatggagaatagccatatgagtgagcactgggcttcactgaaagattatctcaatgaataaggttgggcaggtggtacaggatgaatcctggaagccttgggcctccacaagcaagcataacgtgtgttcacactcatgtaaactatacatgcatatgcaaaaatggaaaaagaaagaaaggaatagtgcagtgtagtgtgtggaggtgtgccaggggtctagaagctggccgtgtggcgccgaggctggaaaatgcttaactgtggacccagtgggtcttggtggcacactgaagccttcaaactctgtttgctaagtggatgtgaggagaatgtatgggaggtgtgtgctaagatctggttcaggaagccgggcagtggtggcgcacacctttaattccagcacttgggaggcagaggcaggcggatttctgagtccgaggccagcctggtctacaaagtgagttccaggacagccagggctatacagagaaaccctgtcttgaaaaaacatacagtccatttgattccagactgcagagaggaagccggggcaggttacaactagattggttggaaagggaagcctggtattcagaggagaggcggctcagagacagagtaattgagaggatagaaaaagatgcctctggatagaaggcaggtgtggcttgtggacacagggatttggattttgagaagcagggatcaataagctcaaataagactaagatcatccctgtctttgcctctcgggtgaccctgccagaattctgatgtggagtcccaggcaaagatgggtaaatagtgtgaggtaaaatgatgctggggacaaatgcactgctctgggcagtcagtcctcctctggcctcctgaatgctgacagacacggagacatcaggccaaacttctggagctgtgagcatccatgtgggcacccccaggactggagccttgaccacttccagaagcagctggtcagtcagcaacaggggtcgctgtgcagcctgagggccggtgatgatgccttcccagctctttaagtgtttcagggcgccccatatgccattcttcaagaaggtacaccacttcctaccacataaagaaagacagatgccctggattccccctgtctttgggttcctattaccataacataacaccatgaccaaaaagcaagttgggtaggaaagggtttatttggtttacacttccacattgctgttcatcccccaaagaagtcaggataggaactcaaacagggcaggaagctggaggcaggagctgatgcagaggccatggaaggtgctgcttactgccttgttccccatggattgctttcttatagaacccgggaccatcacccaaggactggttccaccctcagtgggctgggccctctcccattgatcactaattaagaaaatgacttccagccagaccttacagaggcattatctcagttaaggtttccctttgttcagatacctctagcttgtgtcaggttgacacaaagcactgccacattctctaaggatgctccattctcagacggttcagtcttggtcaaatgttcagttccacctcagggagcagcaaacatcacgatagcaaggaggcccgccatcccataccacacagggaaaggtagtcacactgccgtgaagacatggctctcacgtggatccgtgtttcacagttctagaaaaacctccttccacagaatatcctgtgatactcctgcccattagtgcttccatgttaattattattattattttatttgtgtgtgtgttttttttgggtgtaactctatgtctcacgtgcacatctagtacctgctgaggccagaagagggtttcagatgccatagaactggagttacaatacagatggttgtgagccaccatgtgggtgctgggaattgaacccacatcctctggaagagcagctggcgaacctaaccactgagccatctctccagcccctgccttttttttttttaatgtgaaagtttaggataaaatcagcattgttcttgtaacgatgcttttactccatttgagaaaatgaactgtcattcccccttcatgccttattatattcatagtacctggcacagactgagttccctgcacagcgtgtggcttgctggggttgcaggcacctccgtctgcctctgtattggaagaatctatctcccagcatctgctagccctggcctggccttcaaggcaacatttcctccttctctgcctccatgatcctgtctaaaaagtgggatgcaatgaccttggcacgcaggagaaggtttgagctgagtcagagaagtagggttcaataagttcaactgtggcttgagatccttgcccgatgccacctctccggtgagcctgtctgagtctgacttgttgagtgttagcacagtgaggagggagaaatggaaatggccctttgcttagggagatttggagccccgggaaatctccatccagtccccgagcccagccctgtgagtggctggattttaggacagggttttaggagcctgaggctgtgatcttgtgaggagggcagctgattttgagctgaatttctttgttgtactgtgccattacctgtcaataagaaagagaagagcactctgcattggcaaatgatggtttattgccaaagaaaattgacaacaagcagacaagagaatcattagggagatgggtgacctgacacatccctcctccgccgtcaccctaacagggttttctgaggtatcaagcctctgactgaagaacgcacacttgtcttaaatatccacggtgctgtcattgtgacaagcaatatgctgcagggctcgggtgcccctacatgtcagaaggctgacacccgggtctgggaggtggaccagcacgcttggcaacctgagttgaaccacagaacccacacagagacggaaggagaaaatcaactccataatgtcctccacatgtgtgagtggcatgtgcaaccacatacacacatcacacatgcacattgatacgaaaaacttaatagactgacatcctgaacactcccagggaggtccaaccttttgaaaatgggatattgtcatctgcaaatgtgtgccgtattcatagctaatgtggagcccaaaaggttgggcacattaacacagggtatggtctttggtcataatgaaattcatcatgaaatcaatagtattactatatcttttaaggcccagaatatttgacaattaaataatggtcttctttctaacctgtggaccaagaacatcaatgagacattaggcagcatcagtcagtggctggggctgtaactcgtggtggggcgagcgcctggtgtgcacacagctctgggtttgaccctggcctcctccccacaagttcgaattttgccaaagcagagaggggtgctggataaagtgtgcgctacacacacatgaggactgaagctcagatcccagcacccacttaaaagccaggcagccctggagaccacctgtaatctcagcactcaggatgtagagacgtcctgagttccttggaatccctgggaaagctggctagcagagtagctgaatgggatcatcaagctcaggttccaggataggccctgaatcctcacataaagcggagagcaaatgaggaagtcaccaacctctggcctacacacacaaaccctcatacatatacagccacacatactcacatacacattcaaacatacatgcacacatgcatgtatgcacatacacactcagacacacacacattcacaatagatttgcacacatatgcacacatgtacacatacacatacttacatacacgcacacatatacttagatacactcacatacacactcacatgtatacatgcacagacacacataatcacactcacatgcatacatacactcacatgcatacatacactcacacataaacacacatgcatacacatactcacaaacactcacacacgcattcacaaacacagtcacacactcatatactcatgcactcatatacacacacacacacatacttgtgtgttcaatggctctcataagcacagatataaaatcccttaacaaaatatcagcccacagagaagtaatatataaagacagtgcatcatgacacacaagttttatcccagaaaagcaaagttctttttaaaattataaaacagaagcattttaccatgtaagcagaataaatgagaaaagctgcatggctctactcacagttacataaaaattattagacaaaattcaatacccactcaacaaaacttcttaatcagataaaggactacccaaactgtccagccaacatacagttactcactaatcctgaacgttaagatcacaggtgaacaaagttgtcttccgatgatctctcttcgttactaagtggcattctagccagtgcaataagacaggaaaaacaaaactcacacagcttgggaaggaagaagggacattgccatttttcatgaagatcttactggcttgtgtaagaaacctgcataaaaatgacttcagtgagtggaatctagcagcttttatgacacgagattgggacataaaatacttctatagaaacagccagctggaatgaagaaattaaaaagtagttacattttcaattgcataaagtataaaatattcagaaacaagttttgtcaaagacattagcataaaaaaataaacaaaacactgagagaaacgagatgacaccaaacacagagcaaacttcttggtcagtggaaggaaagttcatacagtaatggtatcagatctccatggtctgctctataaaatgagctcaggcccaaccaaagctacagcgggctgttttgtagacactggaaactattttaaagttgtgtgggcatgcagacgattaggatagtccaaacaactctgataacagagacgtctgggagtctcattatttgattacaagtctataacgcgccaggaactaagtcagtgtaccattagcccaagactacataacagtcagtggggtagcacatagtagccagaagtgggtctcatgagcacgcaaatgatgtgaagtcaaggtcatagaggtttttcaaagagctagagacttacatggaaaaagccaacttcatgctcctacatcattccacccacaaagatgaatctaagatgggtcactaaagctaaactttaaggggggctaggggctgggcagagtggagcaccccttcatcctggcactcgggaggcagaggcagttgaaactcttgagtttgaggtcagtctgatctacagagtgagcactgggacaggcaggggagcaggagagatgactcagaggtagagtgtttgctgtgtaaacctgaggagcagagcccacgtccccacacctgtgtgacaaggatggtggatgtggtctcacctgtaaggaaggccaagacagagaggagcagagacaggatggttggtggagcttgctgttgtcaaaatatagaaaacagataaaaaaaacaaacaaacaaacaaatcaaaaccatgaagtctaggttcattgagagaccctgcttcaaaggagtaacatgggcggtgccagagggggcacagacatgcaacacacacacaggcacgtgcatacactacacacatacatataaaaattgaaataaaatttaaaataaagttaaacaacaaaaagactatatagccttctagaagaaattttaaaatgcatttgttgtattcttggattacacaaaattttcctaaggaaaacacaaaagccacacattgtaaaatacgaaccaaataaattagatttttcaattaattaaaaactcctattcatcacaaaatgcagttaagaatacgagaaggcaaggcatatacaggatgaaaatatacacagcaatgcaagtcaataagaaggcagatggataaacttctcaaaatgcgccaaagacttgagcagatctcacagaataagccccaaatgcaaacatggtactaagcattacttaagaggtgaacatcaaagttacaggagctgctatctcacaggcactataaatagccagaaaagtaacagtcaactaatcaagtgttatggaatgtgacatagctggatttttttttatattgctgataagtttatggaatacagacatcactttggaaaaccccttggcagttcctaataaacttaaacagatagctatccattgtgtgtgcaattctgcacctgggcatttccccaagaaagatgaaatcacgtgtctacaagaagagttgttgttgttgttgttgttgttgttgttgttgttgttgttgatcacagcagattgactgatattagctgtcccagtttgctttctattgccgtgatgagacacggaacaatgacagcatgtggaaagcctggcagtggtggcgcatgcctttaatcccagtacttgggaggcagaggcaggcgaatctctgagttcgaggcaggcctggtctacaaagtgagttccaggacagccagggtgatacagagaaaccctgtctcgggggaaaaaaaaaaagacagcatgtggaggaaagagcttatttggcttataagttacagtcaaggcatgagtgctgctcgctggcttgctcttcatggcttgcctagtctgctttcttatacacaccaggaccaccttcgcagaggtgtccactgtcgactcttccgtaactgtcgttaactgagaaatgctgcccatgggcatcccacaggccacgctgatggagggttccttttcccagaaaactctagtttgacaacttacgttgataaaacaaacaaaaacaaccacctagcacaatagcagaatcgagcaacctaaccgtctatcagcagaacagtgcagcacactgaagtctattgatacaacagaatgttacctgacagtgaaaatgaatagattgtcccaccctatggatgcgatctatacgtgagggttgaaaagaatgatgggaaaatgcatctctattgaacattctggcctctggtcagaattccctatgtaataccctctacttacattatatgtactatatgtggcctagcaatgggaagtacatggaaagatgttacaagtccctgtgtacagaggactccagcacccgtagatctcgatacccacagggaactggttgcaggagccctcaggcactgagaacaccatactgatgtatgcatcaatatgaatgagtcagaaaacattgactaagagaaacccaacacacaaatgcacatctggggctggaggagtagctcagttggtaaagtgcctgccctgtaagcacacggacctgggcttaatccctagaactcaccaggcacggtggcaagtacttataattccagtgctggggaggctcataggccggccactggagcctgcttgtcaccctccaggctgatgagagaccccgtctcaaaggacatggtggacactcgaggaacaactgccaaggctgttgcttctgactatgtgtacacaggcacacaggtacttgcacacacatgaacatgtgcatgcatgaacatgcacatatgtgaacatgcatacacatgaacatgtacacaggcacacacacgtacacacaaaagcaccttctacaggaagccatataaatgatgtttagggtaggaaaaataccggggcatgagaaatggcacttgttgctcttgcagaggactgggattcggttcccagctcccacatggtggctcacatatgtctataactccaatttcaggggctatgacgtcattctttgacctccaagggcattgggtgcacgcatgtggtgcatttccatacgtgcagaccaaactctaacacatgaaatagaaataaactttaaaaattcaagatgggataaataaaatctttgatgatagaaagcagagtcgtggttaaaagcagacagcaccaggtagaaattagctgggaaaggggctggggaatattttgaagaactggaaatgttctatatcttgactgtgtggtcattaaacacatatgagcatttattaagactcactagaatatacccttaagatctgtggatgtaaattttacctagttttaaaaaaaatcataatcacacttaaaatacctaaaacttgagtaatattacaggtgagtgaaaaattgtttctaattatatgctgctaaaattataccataaatgtgattcatagtagagtagacaacttttatattcagcacatgacttaaaggcagagagaggactgttccatggaatggtggctgttttctgcttagtaataaaggacgcacaagtactgttctaaacaccctctccccatctcatgccagaggagactaaatcaaagggaagtagctaggtggggggcatatggctatcaagtggcaaagctggtgtaagagccacacatctgtctacacaattcaggaccaaaagatggcgcagcctgtgaaggtacttctgttgcaagcctggagatatgagttcaggtcctagaatccttttttaaggtaggagtaaagaaccaatccacaaagacatgacctccacatgtactcttggggtgcaccctccaccatcatcatgcattcgtacccagtaatgataaataaaaacttgaaaatatctacctaatggcactgtgtgcatggtgacttgggtttgttagactgcttcaaagaaacctcttgctgactgccccaaggctccaagacatgagactggttcagcatgattattcccagcttacagatgatgacagaggaacggtgttcctccatggcctgagaccctgtggatgggaacccccagttccagggctctaccaaggcccacccagccctgctgaaatcttgtcctctccattgtgttcagagctgtcgtgccctgatttctgcagcttgtgaaggcagctagccttccacagatgccagcagacatagggtggagagactgctcagagagcagctatggagtaacaggaagcacacagcatcaggggaggggagagggccttggggaactctgctgggctcacttcaggaaatgcaaagtgaagcattggtgatttaagcaaaggaagaattagggcaggactgggtggggaaaagtatctcaggtcacatggagcaacaacgacctgagggctagctcctagcaaaaccaggttgaggctggaatttgtcttgagactatcttgcattgtagatggtgaccaacccaccctaaactctcagcaccagacttcctcctcctcctcctcctcctcctcctcctcctcctcctcctcctcctcctcctcctcctctccttctccttctcttctccttctccttctccttctccttctttctcctcctcctccctctccttttccttctccttctcttctccttctccttctcctcctcctcctcctcctcctcctcctcctccttccttcttcttcttcttcttcttcttcttcttcttcttcttcttcttcttcttcttcttcttcttcttcttcttcttcttcttcttcttcctcttcttcatacaaggtcttatgtaacccagactagccttgaactctctatgtaactgtgccagctggttcttgtcaacttgacacaaactagagtcacttggaaaggggtaccctcagttgagcaactgcctccattagattggcctggggacacatctgtgcgtgttctcttgactgacgattgatgtcagagagtctagtcctctgtggatgctgcagccctgggtgggtagtcctgggatgtattcgaaagcaagctctccaagccacgtagagcaaaccagtgagcagtgttcctccaaggcctctgcttcaggtcctgcctcctccaggttcttgcctcgaggtcctgccttggtttccctcagtgacggactgcagtctttacgccaaacaaaatccttcctccatgtacttcttttgtccaacgttttattcacagcaatgaataaccaaacgaagacagtagttcgacgttgactttgaacccctactcctctggatcctccttagttcttccttcaacagctacgtcctaaggacggtatttctcccatcaccctcaagactctcagccccatcagaactctttgcttagctctacattctttgaaaatttatatacactctctcctggaattcctggctcactggccaagctctgggagacctagaacctgctattcctctgttatttgtattcacacctgggtaaccgctaccctgacctgctaggcagacttcatttccccctcttctgtgcttgcacttcatgccggcagcctaattctaccttacagaaaagcttccccgaggctgacacgtctctccctgaggctcataataagctcttaaagattctaattatctcagttcaactttgttccatgagggctgaatggcaggcttgacacaggctggggagggaagacctcttgtcgcctgttgaaatgaaggcacttaagtgtgatcagtcctccgagactgccttgtctcaaaggtccgtctctagcggggccaactggaacagagaacttagtctatgcaggtggcatattttgtactgtgaaatcacatcccgaaagaagctaggacaacagtcaccctgcacataatacaagcactcggctcacctgcatatagcagggtagctgggggggggggtatttttaaatggcaaatgacataaagttttattgtattaaaatcctgaaccctccaagtcgtgatgggaatatccaatggtgtggtctttaatggcattctgagctcagctctacactgactggccggggaggagacggtgtcaatccaaatagctcagtcatcagaggaagcgagggtgctgttcaatttcccatctaacctccttctcacctcactgctctccactcaaggaaaaggccattttctccatcttctcagtggcaagaaaggggatagagcattaggaatttttaatggttttgtctgaggccatttaaaatgaagctgaaatgccagtctctaagactggtggaggaggaagtgggtgacgagtgggaatgaactcaagtgagctgaggtattacagtccccagtgatacctcgggatggtggagggcctccggcttcccccagtgaggataggactgcttgctaatcctcccaaaatgtagctcttccaaagtgtgttttgtttcctccgtgcatctctctctgcactgtttccgagtgatttgtttaagcaaatatttatttatattcccccgaatatattacaggtatctggagggagagagagttcagctcttctgccagagactattcctcacagctgagtccccagaatccaagacaatgaggtttttagtgtatctccaggtggagctgagctgtgatgtatgcgctctacggtgactaatttctctgtgtttcacggcccctccgcagggccagaagaagcaacagaggaacgctttctgcacagtcaaacccgacagtgcctctcaggcctcatcggccctccatggctgagtttcgaagctcttcattcccggggaccccagagcacagtcatatccgaggctcattaagaccttataggatgaaaaggcctttgattattcagagcagtggatccttggggaagcccaatgcacaccagtgctcacctgattctggacttatattgtgtgtgtgtggcctgagggagaaattaacagaggcgcaaagctcaggtgtgatctctcacacttccctcccctcaaatgcttgctggagctgcttcttttccatttttgtttgcttttgttttgtccctggctagtgctaaagactctcctctcgtctctatttcccatccatttttttgtgaatacaatttctctgagtttttcagcatatcgtctttatcttagatgcaactaggcaaccatttccatatgtctctttccacccatacatcacacatacacttaaacacacacacacactgagtcgtttatgtgaaccctggcttcctggtcaggggccagctctccctcctgtgtcataaaagccattcaggctccggaaatctcttattaaacagagtagaatggtggctcatacctggaggacagttgagcattcaaagccaggctatagtgccacactgttcaaaaccaacaggatgaggccactgaggccagaaaatgagagttcattcctacagggaacaagcctggcccagcccctttgctcacctccttcatctgtgtatggcaagggtcagagggctcgggccacctttccttggcccggggcttatcaagaagtgtctttaaaccttctgggagaggatggcacagcatgtttccctaataccaaatcacttggccatcaagccatggctaccagtgacagcccatactaactcccagacagaattgtgttcaagttggaaaaaggcttccatgagatagaccactgattgaagttagtgaggatttaaacatgtttcccttttaattacaaaagtaaagtgtataatctttaagaaaataatcatacatatagtcagggatacaaatcagagactgtttgtctagtacacacaagggcgttgtttgatttttagtcacacacacacgcaaacacacacacacacacacagagccaggtgagatggcacaagccagtatttggaagcctatgccaagtcttgaaaaatgaaggttagcctgagctacagatagagtctatctccaaaaaacagcaaaacaagcaaacaaacagaaaactaaacaattaacaaattcatatatgatatatataatgtacagtaagagcctgaagtgtgtatatgctttgcagtatctatgccttgctccacagagatggttgtttagtgattttggtctttccatatggatgtattaaaatacacgtacatatactgtggaattgtttttgtttaagaaacaatatcctatcacaaggctacctgcttttgaaaagtaagttaattgtaagtaataattttaacgtcgatagaatcccaacccttctcataggatgccatccctcccagaacagtgtgcctcccttttgtatgtatcattcttatatctcatacacacttgatcttgggcatgttttatatattgactgagtctgttccaagcctgtggcttcccctttacagtccccagagagtgggatcctgtggacgttgtcttactagagtccccatggttctgtacaccaagcattccagtgactgtttctcaacgtggtttgaactagtaggtgcattcagtccttgtttgcctatgcccctctgcctgtccctgttctctcttaatttgattcttccagcagcttggcccagaccagatatgtctgaaaagaaggtgatttcagcctttccactcaacaatccctatgggaagaggcagcgtggggcagggagggtggtctgagacacctatgtctattgcatgagccaccaggaaggtagagtctacgtgtagtgtagggcacaggcaagaagctacctgagtctgtcttctctgcaagggggcagggggcacagatatgggaagggagacagagtgggagaaggaaagacctggccgtttgactagcggagaactaccacctaggacatggtgattgtatttccagttagctgaggttcctttgctcagttcagacataagcaggcaaagcaacagctcccctagtgtctgcagctcctccagtcaactcccagctcccagaagctctctgtggctcaccactgtgctgcagttctcgactgccagcggctctcagagttaccagtcctggttactggcagtaaccagtaccagcaatctttggtgtaaccagccaatggtgcaatgaacgatctcaatttgctggtagaaactgccaatacacaaagtagaactgactgagagaaaagccactaggccaggtgtggtggcacacagctttagtcacaaggcagaggctgtcagtgctgcttacacaaaaggaagggtgcacacacgcatgctcagagtcctgctggctaactgcagacctttacagagtcatgccagtctgcccagacatggtgggtctgcctgctctggctgggctgtcaggtggtagaagctaggctgcttgaggatattaaggattaaaggagcaggtcacggagaggctgtgccatgagtcacttgggaccacataggacaccttagcaaagtctcccagagcagtcctcagtcatctcttagaccctaagattgaagggaagttgggacctagtcttggccccagaagatcctgggaggggtttggatgtggtcacagaagtggtctagatgccacaaagcctggcaggatgcagagcctcattgccctatggcccaggtttctgtgagggcagcagggttgtgggctgtcagagaccaagggaggccccaggtaagtggtaagatgagaatagaacacaggtccaccctggtgcctggactagcctgggctttcctacattttagtgatccatctataaaattgagttcacggcctttcacagctagaaggtcagacaagaggttatatatggggattcccctcattctggaaagagctgcatagccaaagggtcaaatgctgttctgacactctcaagatgagagtgagtgtccccatctcattatctagacaagtctgactgtaggatctcctctctccacagggcagtctttctactcccgggtcctggagaactgcgagggtgtggctgactttgatgaggtaggatatctgagtccctgtcctcacccctctccagcaggcaccctgtctctgcccgatgcgctggtcttaaaccctgggtggcttgtgtgcagcatgcctcatctctgagtgacttcctgggaggagcaggtaggtggttgtgggggagccgccactcagcataatcccacaaagtgaggacagagtggagcaatggttgccgccaggtctgagcccttctgacccctgtcgagaaaatacccaccagatttctaaacctcagggtgagtctctctaaggggtcagcggggttgccattagggactttccccagggtctcctggtatccttggaggaaccaggccaccagagcttcagagatgcccaactcacacaagactctcccttcctaagaacatcagggtatctctcctgctatgttttcagacgcatgcgcagtggttctccccgacccccagaggtgtttgtttgtttgtttgtttgttttctgaactgtagactcagatcactgagtatacaaatgactcacttcagtttatgtgccacatctcattggcccctggaaggccccgtccctgtccttcggtatgagtgtatacatgcgtgggtttctccctggtcctcattctttcccctctaccccacttctaatgtagtcagcaaatgcctcttgctgttctatacattctggcaaggtttggactgctgtaagcatatgtgtgtttgtttacttaaatgacaatgtgttaaatattttctgttctattttccactatatactctttctaagttccatctgtgttgcaaagcgctgcttgggacacagccaacagtgggtgaccaaccactctggtctgcccgagatggagaagattctagaaaaacagaccttcagtactaaaacaggcaggtcctgagcaagccaggatgagctaattagtcatgtgctctctaccagggctggttcctagctcatgccattagaaatacagaaaatggtctccatacctcacctgaacctgtgtgagtgtcttcccaggataagcactagaatcaggaattaaacacctaaggtgaccgaccaggcacagtcactgcctgtgcttctctcagcagagagtgacccttcctccacccacatcctcatctatggttggggtttccctcccaggcccctggttttcaccaggccaacagagatctctcctggttgctaggggacatgagtatctcttgagaatgtctttagcctctttcttttgcaaattgtcaccttcctagctgtgttaccagtttacctcttcttatcaacttgcagatcttcttagtatattctagttaacaatctcggttgattttagatgtttaaaacacctgcgtcagatgtagctcaattggtagggtgctttgccaagtatgcacaaagcccctggagtccatttccaacactatatataccagacatgtggcgtaaacctgtaatgaagcattaagaaagtagaggcagaagttcaggtcatccttaactacatatcaagttcaaggctagcctcagctagataagattctgtttagaattagatagttgggggggggagacctttttccagtctatcaactatcaatgaatgaggtccaaagtccaactgttgctttgtggatttctcccaggtactctgtgagctatgggttttatattgtgaaaccgtggtagtagttgctatatttcataatttctcacttatgcataaggttttccttcttgtcccccgtgatgttttttatattaattcctatcttattggatactaagattgatacctaagtatttgtggcacatgactgtaactgagtatttgatagactgaggtaggaggactacaagtttgaagccaatatggagtcttccattttatacacacacacacacacacacacacacacacacacacacacacactgcaaatttcagcttatttttctaaactacattttcaaattttttattttcattacatccatatgttcagatggatcttctcttagatctctttatccatctgagtgtttctggatgtttttttaagaccttttttttcttttaatgtgtatgagtgtttacctgaatatatgtatgtgtaccacatacatgcagggcccacagaggccagaagagggcgttgggtcccctggaaatctagttacagatgctgagagcccccatgtggtttctgggaatcaagcctgggttctctgccggagcatcaactgcttttcatctctgggccatctctccagccctggtgttttcctgtttcatgagtgacaatattcccatctctctagccctggtgttttcctgtttcatgagtgacaatattcccatctctctagccctggtgttttcctgtttcatgagtgacaatattcccatctctctagccctggtgttttcctgtttcatgagtgacaatgttttcatctctctagccctggtgttttcctgtttcatgagtgacaatgttacccatttccatttacttctatggtacgcccactaggtttgtacccatcagcaccttgttttagattacccatttcccattccttttgtccactcttatccgcttaccaaggctcaatgaggcttagtagaaaggttataaccatgtatgcagtccccttctacaatgaaacatcccatcggtgacttgcagaaatcattctgaggagtttctcatttacatcagaaattcaggggttccttgtgcctctctggttcctctgcttcacccagcccttggagccggcactactgtctccatcagacatcctttaaccttgtatcttattaactcctgatccaggaaatcaacaccctcatggagacatagatgtaggcaaaacgccaatgcacataaaataaaaattattaagataagtctttcttatccatataatgttactatttgttacagaaaaaaatctaattaacatgctaatgagatgggtgtgtttgttggtctaatacaacaccatccaaaaatatactgctttggtacactctgaggaataacatgaggaaaaaatactaaaagtctttgcttccgtgattagaacattgtttctctgagagcaggagcctttgtatatacagtggaaacattgtaatccacactgtagagcggctcaggctgaaacagggtttgggcggtgttcatgtgctaggatgctgtgtgtgttgtgtgttcagttcgacggctgcagagaagtggtggcaggcagcacagagcacaccagacacacctcacacttgctaagtgtttgagtttcaattggctttggtcacagcatgttcagaaaccttgactgttaacagtgttagccattcccagcttcagctgtgtgacttccatgtagggtcccagcctcagctttgcgagtttggttagattctggattctagccttgaggttgtgcagtttctttgacttttctttgcctgggccttgttttacttttgaaagatgaatagtctctcaaaaaagaaaaaaataaaacaaaacaaaacaaaaaaccaaaacaccacctctgatttggtttgagagacggattgacagttaagagaaatggctacttattcaaatgacctaggttcaattcacagtacccacgtggcagctcacaactttctgtagctctagttctagaggatccaacaccctcttcaggcctctgtgggcattgtatgcatgtggtgcatagacattcaggcaggcaaaatattcataaattttaaaaataaaattagaaatatctgccacctttacttcttggatctcttgaggatcccttggattttgttctcttcttttttggggtttcctccaaaggagtcgtcattcagtccatttttgcagtatgccttccgaagctctataaatctgggaatatctttctttcttactcaagtttgagagttctactagatcaggaattctaagtttaagattctttttctcacaattgaaaatataattgaaagtataattctatgttatggttaaaaaaagcctgctggccctcagagtcttaaagctctgtgggaaatctttttttccctcttaaaaaaaaaaggaaaaaaccatgactctcataccatatatatatatcatgggtttttttgcctttgaatatatatatatatatatgtatatatattagtgatagacttgaggttcagttgttccatctggctgaggggtcaacctcaccagttatttttcctcctgggccaattctatgtgggagaactgggagttcagacccagggctggagagaggaaaagcaaggtcttatcttgggctacaacagcacaactgcaaggccactgccgccctactaagtgtgtcctgcagtcctgggatagctggactcctcgccattcctgtgggtgttctgttcttgttttctctttctccttgttgtgtagctttcaacgtcagcttagcttcggttgccacatttgtcaaatcatgctgggaacagatatgcattctctctgggagacagcaagcaaaaagagggaaggctgtgataaagatacccccactgcataaagaactgtcatgaggctgcagccccactgcacaacctgttgtctcctatcctcatctcctttcctcattcaggtgatctggatcagtttctcatgggcctgccttctagggcctatagcaagcacctaactccctttcaagacttctaggggccctatcagctcaagtcccaggcaatgagcaacctgatgcccctttgaaggacaatgccacccctttccatgccctgcacccgggacacctgagccacagataatacatggcattcaaagttaatcaccgtgtccttcctctttccagagaagcccgacacggatcaggtagaggatgcccttgatgccactggacatctgcatggggtatattctgagtgtcagaaggaagggtcccctgagctagtgggagaatagggatgtctcatataggaactttacatggggctgcctctgggacagtgctcagtgaacacagggaagaggcagaagccagggagctatggcagacactgacagggtcaagaaccacccccgggtggggagaagcttgctcacattgctacctggcctttaggagtgggggtggtgaccaggaggttcccggttattgcgtaatggagacccactggggtggggtggggtggagccaggagtgataacaatatctgagcagtcctcttccatctactccccatgataactgatgaatgatgacactccgtcccacagagtaagtatcccttacaaggtgacagaatagaagtagccaagccaggattctaagtgaacagcaagactagatctgaaaacctctctgaggacaccaataaaacctgtcccaggccttctgattctggctggcttgttcacaagaaccaggcttccctcctccctctaaaagggtcccatagcctggctaccactggtcacaatgcacaaggcaggcgggacaactcctggacccccaaagagatcacagagatatatcctagcttcaggtaggaaattccccctggctatccctgataggaactgcccatcagatgtttcagaacaagtctgggaaagaagctttatgaacccttcaggggtctctctgtccctatattatgactagggcctttgggaactggcttagagagagacatggggggccttggagtcaggagacctgggctaccttccctagggtgaggctttgcttgattcagacacaggtaggtgagccactttgactgagcaacctgagtgggcaggaggtagctgggaagaaaaacaatgctcatcctaaagtgatggaaacagagccaggcagtgtcccctttcctagggactggaacccgagatccctcattgagcccgtggctctgaagaagctgaggcaggaggcaaggctgggggtgctgaaggagctgagagagcatgtcaagtctgtctaagccccagcctggtttggttttaacacgggcactgtttggaccccatgccccaccctaacccctatcgcccacccccgcaccctcaacctcacccccactccccacccctacttcccactcatcccctccatccctgagtaggccccaggccttcgagattctggctggcttactcaagtgaaccaggtttccccactgctcaatgctaagacctgggcacttaaggggagagagcgttgcctgagctttcctctctgtgtaacgggcttgaagaacaacacccccaggtcagaaggagccatgtcaggatttgaacactggtctgtctgattcctgtatgcagatctggaatgctcaaccagctagtgttgtgcacaggcctgtagctctagcctttaggataagcagtaggtaaggtgcagacgacctacaggcaccatagaggtcacttagtggaacttcactattttacagcaggtgaagtgggtctgtgtggggaaggggctccccgagacttccaaaggaacacaaacataaaactagaacccaggtatttcagctcccagaactgtttctattataccacaaatctctacagaaaaactcaactctcaagttccccctaacagacacacaaagcaagagggtatgtgtcttctgaggatgctagccttctgacaggacactccacacctagtcagcaggcaagccagggctaattcagctcatcctcccacagatatcagggaactctgtggagtcccagatccctgaggctgataggatacagaacaccatgccctggccactaccagccaggttagcccaagtctgtagatggtaactggacactcaagtgcctctaagactgttccaggcagagataaccttttccttcgccaccactagtacatgtcccccagctcctgtaaacaggcccattgcatgtgcttcaggttgttctgtcctcagagcctgaaaacaccctgcatccctgcacctctgcgaccctgcatccctgcatccctgcatccctgcatccctgcatccctgcatccctgtatcccgcatctctacatctctacaaccccgtatgccacacagagcacaaagaatgctgagcaaacatgaggtggcccgtgatatctagggcagcagtgtttggcttagcaggcccagggtcccaaacttaggggttgaatgaagcagaatattaaatagtgagttggctttcattggcaaccacttttctgggcacttccagaaataaaaaccactacccttacctgcagtggccacaggaagagacttatgataatgctgccaagctggagaagtgccctatgtccccagaagcctctgcagctctcaagtgtctgtcatcaagaagccaagtcttgcccagatcctggaacaaacagcactgtaataacaattataataaatggccccattaactaaacacttcctgtgttctggctgtctgccaaaagcccagccagcctcaaagttagccccaaaagaactcactcctgctatcacctgatgggtgtctgtactatagtcccttctattacttgagacttgtttgctggcagtccactgtgtaccagaccctgtaagagtgtgaggaagccccgtggaccaggcagtcacctgtgctcctgctctgattaccctgatagtgaccatcatgacattctgggagtcaatgggaaggagggggagcaggagactgaggcaggggcatgaaacccagctctgctgccggtgagaagtgatcttgacccagaccttacaaggagaatcacgggcagaatggggtaatgtcacggttatctacagctatgtaacatgcccccagtggctgacaacctctgcacttctgattctgaggctggctctggctgtctgctggatggctgtgatagtgttccagcatctatctgggtcctttctgtctcccccagcctcacatctcccagggcctcccttccagcaggatggcctggacttcttcatgtgccactgatttccaacataaggaagaatggaagtttccgggtctaggtgccacacagcctcatgattgaaaccttttgttgctaaaaggcataaggccagcctagactcaaggtgaggtaacacagaccccatcttgtgagaaaagatgtcacagagaaaaaggagagagggggaccaggagcagacacccccggatatcagcagagtcatgcttccccagtgtttaccttgtgccggagccaaggttaggtggtataccatccatactgggaagtgtggtaacttatccaacttctcatagttgttaaacatcagcaccaggggttgagcctgtatattctgcctcttagtactccattgatctaattaataaaaatcaattaataagctacattactgagcaaattctaaatctcagtgtcgttctctgtgaagtgaagttaaactgttagaacactaggtgtcaagtggtagcaggtacccagtaggtggtcagcactcaataaataaatgatttttgcagctggcaatctagaaggacaatcagaaccacgggcccctcctgaaacttggctctctctaatctacctggctcaggagacagcccagtgtcagggagtaagacctgatctaagcttgaagactggagtttagtcctgcctccaccaccaatcagctatgtgcccttggatgcttctctctcaagtcctctcagcagaagggcatctttgccacattgccagagttgttgctagagagcattggcccgaggtttactatcgagatagaaacctccccacataaccccttcccttcagccagacacttcaggagttgagcagcattgtctggttgttgggggtatggtgagcaatggctcctgggagctcccaagcccccaaactcccccaccttatctggctgtgtcctcagcatatgtgtgcatcactgtaacgggtacaaagaaggaaatgacagccaaagggagacactgagaaatgaaatcaggatgaggacaaacaaaagagaagacatgggaaggccaaggcagataaagtgtgaaggtggcagaagcagagcagagaagggccagggaaacatattgacaacatgcacagagccttgcaggagggatggagggcagggagcgggaagcaagcttgaaccaatagtgactttcgtttctgccgtgctatgttctctttccatataacatcctgtcgctagtgtgattccatttggttcttttttctttccttctttctttccttctttctttctttccttccttctttctttctttctttctttctttctttctttctttctttctttctttctttctttctttctttagtgtttttgagacagggcttctctgtgtagccctggctgtcctggaactcactctgtagaccaggctggcctcaaactcagaaatttgcctgcctctgcctcccaaatgctgggattaaaggtgtgtgccaccacgcccagcttccatttggttcttgcaacagccttgagagatatatatttgtcttagtctgtcttctgtgtctataacaaaataactgaaatggggtcatttctaaagcatagaagttcatttggctttctgttctcaaggtgagaagtccaagagcatggcaccaacatctgatcaacatctggtgagggtctccttaatgcatcgtagtatatcatctgacatcacacagtgaggtggggcaagtgccacatagggcctaggatcccacatagagattctaggtccatcgggatcaaagctggggaccaggagcctcataaaatttccagaaatcagtctaatgagcaaccaggagtgagaaccaatgagagacagagacagggaaaggcagcgatacagaaagacagagacatagaaatacagaggcagagacagagaaagggagagacacagacagacagagaggcagagacaggcagagaaaggcagaggcaggcagagacctagacagacagagacagagacagagacaatgcagagaggcaggccattatgtcctgtcagctcttgtgacccactgaactacacctcagtggggacaagcagaagcccgctgtgtctctctgagtctcctgtatccggtcatcagttcctccactgaccccactgttcccactgtgtctaaaaccattctcagggtcaccaccagcttccccgactccttctttcttaccagtgccaggaaccacccatagcccccaggtggaagaaataccttacctgcttcaccccaaaacaacagcctcaatgggccttccgtaccctcccctgggcccacagctaatgagtcaggcctctaccaccatgcagtcttgtctaagcaactcaattaagaaagcaacatgcttcgtagagccgagttgagctgagcactgcaggcctcagacagcaggagccagagctgtgctgaaacaagtcctggggctgccaggagccccacctacctctagcctctctccatcccatgctcgcatcatcagcgttactgtcgctgtgatgaaacaccgtgaccaaagcaacttggcggggaaagggtttatttggctcatgcttctacatcacagttcatcactgaaggaagtcagggcagggacctggaggtagaagctgatgcagaggccttggagaggtgctgcttactgactgactcactcagcctactttcttatagaaccctggaccaccaacccagaagtgaaccacccacaatgggttgtgccctctctcattgatcaccaattaaggaaatgccccacagacctgcctacagccccatcttttctcagttgaggttccctcctcttggacactctagcttggttgtcaagttgacctaaagttaacttgccctcacggtttccccgggatctggcccatcctgggaggagatgatctgaagggagatgacagtgagcagccaggatggccctgtaagcccaaccctgaaagtcctcagtctgggagaaggcagtccagctgtggagcggcaggcttacaggggcagctcttggaagcttctgctcagcagtgtccactcggccaccagcagaactctgcctcacctctacttctcagagctgtggctacaatgtccatgaaactgggcagacaccagcttcctgggctgttagaaaagctaaaaaaaacaatatgcttaaagacttcagcctcctgcataatgccaagttttctgtaaacattattatcactgctattcctgaactgttgactggtctgaactgggtagggaacataggggacatttaaaactgaagtcactgtgctctgtctagtctgtgaaaacccctggtaccgtctttcaatagctcctagcagctcttgatgcctgccagtcactctgctaagccaaagcccaaccgcactggaggtgttgctcagtgggtagggtgctcacctaacatgcaagacagtgagttcgatccccagcacccaataaaacagatgggatggtgggagcctgtaacccagcgcttaggaggtgggggatgttcaagttctgggtcagcctggaatacaaaaccagaaggatatagactccagcccacgccagtttttttccacccttttcctctgtcccagttgttcctaccctgctccctttcccacaatggcatgatcagccccgtgttcagacaggtggccttgagagggaatgtggggcagggtcaatggaggtgatggagaccacaggccacaatgggttagcgccaatagaaacaaacatctctggaggctgggttcattgagaggctcatttaattaagaggaataagggctatttaaacctttggagcgtgggtagaggcttcagggtaagtgaatatcattgggctgagccagggtcctgggatgtctcatttgcataaggaagaattccagatgctgctggacatgaccttataagggaaagtttaacctggctacctgtgacctcttctggtggggccaaggtagaggcacgggtagatgtgagccaggatatgtgcaggagaggaggggagatgcagacacggacacggtcctactcctgcccatctctggtagagatttccagggtttggacacacctcaaccccactcttactcaaggcctgctccccacagctccatggctccccaccccacatatatcctcatgcttgatgcaccaggtctggaatgaacgtgggtcccattcaggtcctcttatcttcctccagctttaacggggtgtgggggtgtggtctctacaatgggtgtggctcatccttgtgaaacaagttttgacctgccttggatacagtcagcatgcagggggccaggggaaggggtggcatctacaaacttggacttcctcgattatgttgtgtagtgaattctgcgagggacctgagtggcctgtgtcatggtatgcatcccagccttgagcggtggctctaacgcactgtcccttgttactggagggtcagccctacggcttcccgggacggcaggcttttgagcgagtcttcttggtggctttgcccagcttggctcacagagaataaagtctgtatttaccaacagaggcatgccaggcctctccctgctcagaaggcagggtctctggggggtcagaagtggtgatcagggtgcacagcaggccattggctttccttactggcacacaggggtccctaggagcttgcatgatcctgacattgatggctacaagttatttctgtagagagtacaacaaatgttgcacacagatgaaagtctttctagcttcttttcttcttccccaattgttttgttgttccaaaagggaggaaggctaggcaaggactggaatgatggagccttgaggaagccctaggaaggtgcctggctctgcccatcattggctttccctagagaatgactccttttaccatctgcattgggttccagttgccactcttcgggcattaggaaaagacccactgaatttctaatccatccgtattattaacttagagatgtctccaggggtgtgaatggagaaacagaaagtgggacagaggctgtaagtctgacccttataacccgagagagctgcagaacgtgtccccattgttcgcactgtcaccatggagggtgaccagggagagcctggactcatccaaatggcttatgtgagttgtgaagtctggactccagtcagcttgtcctgaaaccagctcccaccccaccggtggtctgtgtttactggagcccacccacaccctggccacaccaccctcctcagctgtcacagagctgggaggcagaggaaggcacccacagatgggagtcagaagcccttcttaggcctaaggtcctccacttaccctgcgaccttggcagcctggacaaacctctctagcaccatctttggaggaggagtgggtaagaagacccaccacacaacgctgctatgacaatagagtaaggatacagatgatttgcccctggggatcctggcccatgggaggggccaggctggctgctaggaggccccaactccttgctatttgcccccaaggctgcagctgtccctctctccccagacgttccggtggccagtggccagcagcatcgaccggaatgaagtgttggagattcagattttcaactacagcaaagtcttcagcaacaagtaagtggggaatcctgggggccggcctggttcttggacctctctttttaggcttaaaacagaaactctgtactctgaggccatctttaaaagcctaagaggtcttaggctggtggtcttggctatccattttgtcctttgtggggtcctcaaagtaccctggcccttccatccactgtcaagcaagagtacctcactctcctgtgcacccctcaattctcctccccatttacactccatgcccctctttttgcctctcccttactcgtactggaagatggtagcccaccagagaagttaaaaggctgttatatcctgtggtgctgaggataaatgtgtcttacagaggctgccggtgctgtggtttaggaggcagacatggtctcagacccttggtccagtgatttaagatgtgagcctgagcaggttacataacccctctgagttcactatactcatatgaggaaaatataaggatttgtctccaaacagctatgggaattaaatgagatagatctgctcattcatttactccacaaacagtcatgatatgcaaactgtatgtcacgaactgagctaggtattaaggagagagatgcctaacctcctggagcttccctcctgtgaatgaagttcacctgccacgtgagtgttatcccacaagctgatggatccaagtagccccgttctctgtggttgacgtacacattttagaaggtgctgggatggtggttaaacaaaagtgagatgagacactcagccttggagtcaaaaatccattgctcctatgatcatggctgaactgtaaggtgtcccaaaagatgtgacagcgctagttcagtgaagcctctgcgggactcagcagtaggaagggagtgtagacacagaaagctgacctaaccctggatcacattagaggtgatctcaacaggggaggcaaagggtctactctttccagtagctgtggctgtctggagtgaacactctaatgttttccttatagcaagtagatgcaaacctcaagaggaagtcctagggacatttagctactcacccacatgtccattcatctgctcatccattgtttcattcatccatctgtcccatcccattcatgaatcctacctattcatgaatcctacctatccattcatccattaaacacatccattccattcacccttctgttcattcatccattcacttacccatctcctcaccctctgcattagtcatgactgttgctaaaaagaggatcaaggcaaggctctgtcctccagaagtcgtttgtcatgggaagaggagaggcacacaagaaccaggctgtgtcactaggagaacagacatctggaagagccagaactctcaaacatctgtgctctctaaggaaatgttcagtgcccaccactgggggaggtgagccaaacagataaacctcaaagagcagatttcaggcctgctgtcaggaccacagaaagtatggctagggccagaagccttctctttgtctccaaagggtggcatcactcagtcagctttttctggttctacaaaataataataataataataataataataataataataataataataataataaggaaagcatccccaagataaaatatggctttcttatttggtgtgagacactctgtgattaataaggcaggggaaacagggagaagagaagggcccagtgcagactgagtggatacagaagaaagcagactcagaaaccggggagagaaccaaagaactccacccagggcctgtctacagatgccagagctctcaggagctcagtggtaaaacccttactgtgaaaaaagggaaactgaggctcagaggcacatggaggtcatgtgagaagactccaggagagcaggggcaggacatatgtcctccacctcctcttctaaccctctgtagctctcagcagccaaagcacatgaatgctgcagaagaatctgaagaagaggttgctgattcgccacagtgggcattgccagagcagacaccgaagcgcagagagcctggatccatcaggattccggctatagacaaagtaaaagattgaggaattttaaggggcattggatgaccacacagtgaatctaccaaacattaaagctcattttaggttttcctaaatgcaaaacagagggaagatagagcaaagtggcctatctcctaactgtgccctcccttcccccacccaagagaaagcaggaaagtcacatgggaccaggcctggtggaggatgaccattcaagccactcttggccaagacctaagatgtgaagaagagacacaggccaaccttggagtaaggtgcttggagctaggtgggggctcagggcttcctaccttggagttagagaagaggactatctggttctgtccagtggtgttagggactgccaggaggtaaagacatggtacaagggtggaaagctgctggccagggaccataaggtccccaagtgtcctagaaccagggctttctccaagaaacctggaactttcatgaaaacatattaggaagaggttttatgtatcctgtgtagccttaccaggactttaaggggcaatggctccttccaccaagaatgccagctgctctgaataattcagaagccaggagcacagtggcagccggactgagcccggggcacttgacaccagctcccaggggaggacgataaattattgacaggattctggtgcccagttggtgctctgctgtggccagtctgtgagcccatctgcacttgaggcctcctccccattgcccacctacctgataattctggcttctcccaggctactctgtagggtttccatgagggctgccctctttctaatgggtgtgcttctagggccacataagggatgtgtggtcagcctggggaaccaagacccagctagacagtaggttgaaaaaattctttactgagatatcaactgtccatttaaaactttattgttttatgggttacgatcttttatttattcatgtttatttttttgaggaaaggggagctgttttatacacacacacgcattaccaccaccaccaccaccatcaccacaccaccactttaagatcttcaagggtcagtgacagcctggctctgttgctagcgctcacctaacagagaagaccagacctggctgagccctctaaatgcaggtcacacacaatagcaaggagaagagacagtgaggcagagggcctgcagcaatacagagctggatctccacaccagcatggagggtgggggtggggggagatggcatcagaatctttaagaggaaaaaaaacagcacaagacttgcagaggttgcagaactagctaccatcacataactaccgggggtgaaggccccctgagggactgctacatctgattccagagcagaactcttccatagtctatgcctcctcccttatggaatgacagatcacatgtccttagagcttgacccagggggcaaggaatgggagattggccaggagggcggtttgctgcatgttgcaggcagtgaggtgtggactagcagtggaaacagattgcagtattaatactggtgttgccttccatttcctgtctggacgaggcttgaaagcttgatgggaggggtcatttcaaggattcgcactcgccaagttctcctcccaagcccctcccgagtctaggatctcagactgtaaaggaaaagaaatgtagaagacatcaccagaggctctctcagcaactgcaggggaatggctccctcctgccccctggggggtgttttgtaacattgcagcaccttagtagatcctaggcacctcctttggctactctcgggcgtttcagattgagaacaaatgtgcctgagttccagccctcagcagttgcctggcagggcttactggggtgacaaggactcacaagagcctgtcagcaaaggctcagggtaggacagcttctccatgtgtgccccaagtggcagtaacagcatcaccgtgcttgaaagtgcacatactcagggctctcccaccgccacctccagcctaaaggtgtagcctgcagagtcagcagatccctctgggggaactgttagaatattaaaattgggtgtgctgtgagtgtatgcactgcagaaaccagtgaatgctgcaaaccagcagtgacagcaggtctatgaggagttggcgcatccccaagactccattgatgccactgatgagccaagcacttgaggcctttacaaggccagtgcgttccttcatgcccactgctgactgttgtgatctcaccaacttggtgttctaccccttctctttataaagacaggacataaactccctagcagtgacttgggatctcctggaccccagctcaggactcagtgctccacccacccaccatgtgtatctgcaaagtgacgagaacccaagatgggactggaagcttctatggaacttctctgggaagaatcaaaaacccctaagtcttaacttagcacggggggatgggagacgtgcgactcaatgaggccgtgagcttggggggcaagcatgtcagaatcatctcttacagctgttcccactgtgtgctcttgacacagctgggaggactggagggggagacatacatgttcatgtgtatatgtgcacatgtgtatacaaatgtatgtctcctcttcctctcccaccccatgtgtgcacatatgtgcttgtgttgcacacatgtacgcaagacgtcaacattgggtgtctttctctatttctatctacctcatcatttcttgagacagggtttctcactgaaaccagggctcactgattgtgccagactgcctggccatcgatgagctctggggctcacctatctcagcctcttcatgctggagttagagatgagcacctctgctcctgaccttttggggggagggagggaaggaaggaaggaaggaaggaaggagggagggagggagggagggagggagggagggagggagggagggagggagggagggagggagggagggagacagataggcaggcaggcagacaggcaggcagacaggcaggcaggcaggcaggcagacaggcaggcagacagacaggcagacagacagacagacatactagggatctaaactccggtcctcactttcatgagacaaacatttcagtcactaaactatcttcctagcctcagaatttaaacaaacaaacaaacaaaacagtgttctcccttagtattttataagcaacaagcatgtttttgtcagaactcactcatatttgtcattaattagttgcgtcgctgtcccctttcttggccccacctctctctacaaacttcaagtagcacaagtgtcccccagattgcttccaagtttcacatactgtgtgttccttgaacctctttgtcacttctgtggaaatggcatgagttctctgtgggtccaggtggatgtaccgcaggaaggcatctctctgagtcctctgatccctcccagggcaacagctttccagtctcagcattgatcaggcacccaccactgctcagccattgaggaccctggtgtgtggggaaccgcagatggagtttaaatatagaatacacaggctgtcctgtgaagaccacaagtaacaattggagcatcaggtggagggcgtgtcggggggacaagcacgtcatttatgaagtgaaattaagatcattagcttagcttagaagaaaactaagacaagaaagcttaggtgagtttccctgggcagacaccacccatggaagcatccgagctgggtttctgctgcagagattgtctctggtgtgattctttgtgcttgtctccgctatacaactgaattaggggggactctgtggtcccaggagcttatgcacagcaaatgtggggtggatgtatgtgtggtgttggtgatgctagaggcctctactccagtcaggaagtagaagaaaggagtgcttgtgtagctagaggtctaggctgggctgtagctcaatggccaatcacttacttgtccagtatgatgcagagttcagtctccaacacacacacacacacacacacacacacacacacacaccctgacactgccacccccgccatcaccaccaccatcatcagaagcctcgatgccttcccaccaccttccattatggcatctggaagcttccatactgcaggggaccagctgcagtcccggtgctacgttccccatctctatctgtggacaccacttagaattctttcttcttcatttccaggggacacttaaggggtcagacaatctcataacctcaggttactgggctactgtctccagtaccaggctagggttttcatgtttctctcggtctctgtgccagccagacactgagatcagccttgctctggcgctggcaatgtcccttctgccactcacaggctgatagggaccttctgcatggtgctgcagaaagtggtggaggagaatcgggtagaggtgaccgacacgctgatggatgacagcaatgctatcatcaaggtaagtgtgttggacagtcccagacactccaccacccagtcacctaggagcctgctgcatctcccacagacgagggtttagaaccatggttctcaaccttcctaatgctgtgacctttcaatacagttcactatgctgtagtgatcttcagccataaaattattcctactgctacttcataactacaattttgctacttctatggattgtaacgtaagtatctgtgttttcctgtggtcttaaggtcatttgacacacaacccctcaggttgagaaccactggtctagacaatgctccatgactgacaagggaggcagcaggggacaccagggaggctctgccagagctgattggtatgaaggctggtgttagaaaccctgtggtgtggatgggtctatgccaagtggatactccacttttcccatgtgccaggtgaggttaagaaggttgccccccactgatgtgtgtctccatttggatccagctcaggaggggattagaggtacctcttaccatccaatggctagattgacccttgccagcccttctaaggcaggatcaatctagagattcaggatcaggatcagaaaatgcttctgctccatttgtccatttctgatcaaatcagcatgggcatgtacgtccccgagttaccctccaagtcctctgtggccactcacaggcagccagcaaggtggtgaggagcctgacccatggataggattcttggttagatctgtgtagcaactgcaaggtcagcaaacgtatatcagcctcacaggcttgttctagggggtcaagggcatacaaagaaggtgcttagaatgctaggtggtgtataaagagcgtttatctcctaccttagttttacccccatgcaaattaaggctgtgccttctagacatggtccctccacctgggttctgtttaacatctgcacccagatgtggtgttccactttctccagagggaaaaccaaggcagctccccaagactcccctctctaggctatcagttaaatcctcagaagagttgaagaaacgctaactgcacaaggttgtaggaagcccagggctgggtcttctctgagaagacatgctcagctaactgtaccactttgtcagaggagcccccttgtgcctaggttctaaggatgaggagttgacctagtctttgggcgcctgggaagaggagagtcaggtacaacagaatcagggtctcactgagccagctgacacctcaccatccatcttactcagccttattctctcatctaaactgaggtgggaaggtcctcacctagtcttcatagggagcgaaagtgcctcccagatgccacaggcaccagggtactgctcttgcctgcgcaactgctcactgtccctctcccttcagaccagcctgagcatggaggtccggtatcaggccacagatggcactgtgggcccctgggatgatggagacttcctgggagatgaatccctccaggaggagaaggacagccaggagacagatgggctgctacctggttcccgacccagcacccggatatctggcgagaagagctttcgcaggtaacaggctggccgtctcttcttgcccactgctctcaaaaggcctgggaagttggtgcctggagcccgtgccctggaaggccctccaggcctggctgtgctcagactgcagagctgagctgttatagaaatatttaagagttggaaagatggtcacaccatctctcacctgcctctcaaccagaggctctagccagaatgagaggccaggcctgctccagtcctgagggaagcaaagatcagagagagagagacagagagacagagagacagagacagacagagagacagagacagagagagacagagatctaatataagggggaaactggatctcctgccctcatcggagacatgggaaaagagagtgggagaggccttggtttctatgttctaagacccacagtgtcagccaggccccctggcagcctgacctctaccttggcccagtgaaaagatccctaagccagagacctgctgttgccagcgtgagactgacagtcctggtcaggacctggccaccgctctgttgtccaggctcttctgtgtctaagattcacatcttacaagtgccctgccccttaccgatgacagagggctttgactaggccttacctccccacacgcaggacttttttttttaccagggagaaaatgcaattgcattactcgaagtccagagggcagaactgaagctagagagatctccctagatacctgggatgctgagaacacacagcagatgttttatttcgacccaagaggtctggggtgcgttttgagaacaagcttccccctccagattccttcacagatttactcagcccctgccatgttcacacaggctcccagttagtgagctggaattgtgatgattttgtcacacagaccctgcctccatcaccagcctacttcctgaacacgaggttaaccacaaatacaccacacaaataccaggtcatttagtgtgagcccaagcctgagtgccagaggtcacacaacttctctcagcctatctactaacctataaaatggcagctatcccctcaagccttgctccaaccaccaaccggttggtgacccaaggggctattggaggtcataaagggagagccaagtgttgcacacggaagggctcatgagaacaagttcttcatcctggatggtgccaaacatcagaaataggttagagatgctaagaggaaggacggtgtaatacgtaacacaatggctgccgcctgaagagctatgtggggatgcttcagagtgggttctgggagcgcatgcacacgagtgcatacacacacacacactgtagaggaaggaatggtggtctgagttaggaaagctagctagctccatctggtccaccccaactctgccctcatcagctgggtgactctggcatgtcaccaaacctctgtggtcaataacaaaaaataagtgagttagaaggtagacaggctggctctcctccctctggcccccaacagagcccaggttactcggacagccatgaaagcagcttcccccagagggaagcgctgcctcaagtctctgccttcatccaggggccccttgtctctgcccacactttacaaaataaccccaaggagggaaaatgctgtcaagagacagcacaacagagtggagacagtaacacccaagtgtccgctctgatgtttggggacatagctccccaacagtaagacggctcacccatgcccacaagagaattagggaaaagtgagatgcttactatatatgaaaatgaggtattactaatgtgggcacttactaatacccattgtacatggaaggtaggttctcagccaacattgcctcttcagactccatgttaccttgaccccacctgtttcacctgtttctcctctgagcactgtctgaccagtgtctggtccaggcattgttaccaatctgagtcttatcccgacctatgcaagggcttttccagggatgccaaccagaggctcagctgtcctgggcaggaacaggatctctctctctctctctctctctctctctgtgtgtgtgtgtgtgtgtgtgtctgtctgtctgtctgtctgtctgtctgtcagtctgtctgcctgcctatctgtctctctgtctctgtctgtttgtctctctcataacacacatacacacacacacaccaatgttcctgctgtaagaaagaaatgaattactagtctcacgagcatttccactctcaggaacaaagaatcagtattcccagctgtgtctctgtctcaggacagaaggagattctgaaaacatgcacatacatgctcgcacgtgcgtgcacacacacacacacacacacacatgcacacacgagtgctcacactcacatgcacacatgtacacacgtgcacttgtatgtttgcgtccatttgcctgcacactcactctctgcttggtgccagggagccctatgcctctggctatcagcttctgctgctaggagtcacatcttacaaaggagcttcagcttcaattgtgcagctaatcaacacagtcttttgtttcccccaagaccctttgtcctccgaggcttcctttccttctcatcttctctacctccccagccgcacaagcctccacagcccccaatgccttcagcatcccagacctctctggtgtccctggggatgtctaggtaattacaatatcattttcttagaggtaggttgtgaccagggccattcttgtcctgcctgtgggcacacttccactcaagtggaaacctgtaggatccacaaagcctcttcctgtgtctcaagcagagagcggctggccatgtgtgcacagcaggggctctggtgcatggatgcattaaaggtctgcatacgtgtgtgttcatggtgcagcacatgtacctgcctcccctctccaggctgggattcagctctgcaatggctgccaaggagccaggggaaccagagccacagccatgtgggagttcaggagtaaaacagttctcccatgcttttctcctacctgaggttggggctcccaccctcagcccaaggctgagcaacccaagtgaggcctcgtgctgagacgtgcctgggtcttggtgttcccaggagggcactccacttttcctcatcctgtctgtggatgcttttatcagttcaacgagtggtggggatggagctaaggaagaggaattgttcaatgaggctgaaagtggttctcagaagaggatgctggctggggagcaggatttacacaacaggcaggaggcgccaaaagtacaatgtgagcactaggaagaaatcctggcatagctggggcttcccagggtgttctgtggcaatgcaggcagaaggtgaggccctgctttccagaccagtgacagagggcagcctgagcccaaccatcctaagaagcaggtgatgataaagatggctgcttcatgggatgatagctcgaccatggcagtggctgccgaaggtctgagccccagctttgcacctcttgtctctatggagggtggcagaagtaagggtgaacgtggtaaaatcaccatggtgctctttcttcataaaaacagcccttcccttgctccgtttccactcttagagagtggatgccttgaggcctggagtgtggagagaagagagagcacacacactcatcgacagacatgacacctctgagttcagagcaaagctgagagacagagacagagagagagagcagttcccagttaatgttcagtatgccagttccatgtgcctgcagacctttgccaaccccaggccacacaggtctcttttgtagtccattgcagagattggcatggttcccagggtcacaggagtcttaaaaaaagatgtctagtcagaaagaaaaggaaaggaactctcctagagcaaacgtgggggcagagaccagaagtcttgagtggagttttagttccctgatagctcacaggagccctagctccattagagcaaaccccagcagcccttggggattcctagcagcagcccttaggacaacggggctggactggggcagaataactaggtctccccttccctctctgcccagagctcctggctgatctgggcagccagaaacctggcagttgtggggctctttgaatcacagactaattcgcttgcccaacacaaagccagccatatctagccttggacggtgactgtacagaggcttccaggcctggggtctctgtggcctcccctaggccaggtctgagccaggaaagtgggtgagcagaggaatagtcatgaaggttactagatctcttttcttcattctcattgactcagtcctgcagagccttggaagaacattccagtttctggaaacctctctgaaagaagatgggagtacagctctcctgtacctctgagccctttagtggcggcttgtgtacagcacacacccctcctcgtcatctttcttctcagtggctgaatgcccggtcttgtagcagcctggtccctatctctcaaataggctctaccctctgtgtccctggaagaccccacagcatgggtaggacataccccttgtaggggagcaagggaggatatgaaggaggaagaaatttgggggaccctacaactctggaatcactaggccttctcctagaataagaggagacttggggggacctgggaccatgacactcctacactgaaggcttagtcttgagatgtgaggggtctgtgggatagggaagcccctggggaggactgtgggggtcagcagggccaggggctgtggtcgtgagggtctctggccccactctcacttgcatccccttgtctcctcgtttctccccctactcagcaaaggcagagagaagaccaagggaggcagagatggcgagcacaagtaggtgccccaggccggggaagtggccggacctcttcttccccctctgggttcttgggggtgatgctcccttcttttagtgtctttgtccttctcttcttcactggccatccctctggaccttaaggttccctgagagaatgcatatagctgacgagtggggaacacaagaagccaatgtccaccctcgagcctaggcagcactgtgcagttgaacatagagccttggagatccaaataagacaatctctgagcatgtggctgcatggtgtagccagccaaaccatgaagtacaaagagctgagcagagatgtccactctcttcaacccccacaatctccattcctcaaagggcacgctagggtatggaggcatagggttatctgatcagctggtcacaaggacccagcaagattggcttgaggtgatagtaggctccccaaagccacactgtcatctggagactcaagagtcacagaaattacagtaatttatgtcttcaggactgatcacactacaagggaactctgaactttgtgtatggtggcaagtgtcagttccagagaaaacaagaaatctaacttcctacccagagttcatgatgaacccaggaagttaaaactgtctaactggactcaaaaccaattaattcttcaaatgctaaaaacccagagacgtagtctatttttcgtctttagaaattaaactccagagatatgaagagatttgctaaaaactgtgggcccaatactttaaagaataatttacagttgtgtctgtagtagtctgagttgatcctgacaggtgtgtctgtatatgttaagatcctagggaacgtggaaccttgtccactgtgttgcccaaatcatactgagttttggtcatgcttgtaataattgcataagttataaccatgaccactgggcaacagaagcaatacgctgtgtgtggagagtaccacacggagagatagagcagtctgccagcttctgagaagaggagagtgtgtggcagggcagagagagtgaggggtggggtctgagtcccagcatgggtaagaggtggtaaggacattgatctgggggtctttcttagtgagaaggccaatgaccctgtgtttctctgtggccacttagatgtcaatggcttacccaggaagcacagcttctctccctcaggttctctctgaggttaccaggcctcagagcccatccagctcccagtctgtcaaactggcttgattcctgtgactgaagcgggggtagactggcctcacaatgcaggcccatggcaggtcccgaggatgtacgacctccctggccctacttcatcttgtttcttgctgtcccattaccaaatgagattaagtcagctaggatgtaatattattttaatgtctccgagaactgggaatggaatctctaagatgtgattaagcaaactgaaactcttcatcctgagaaaagaacactgtgagaagagtttgcagatcatggcaactgtgcggccaggatggttggtttatccttgggctgcagagagatcagaggaaatagatttgacctagaaaagaacaggtgttcccccatggggcgatgggaaatctattcccatgttagtgtttgttaaagctttgccaaagaattggcaaacaggaagaaaagaggagccagattcccaggtcaggaggaacacttgagggtctcacagtccctctggtacaagagggacacatggacaaacaggccaaatggaaatggtatggtccctctattaagggacagtctggaccagggatgtaactcagaagtaaagccttgcctagcatctgggaagtgccaggattggttctctagctctaaaaatataaattaggggctggtgagataactcaggggccaagagcactcgctgctcttcctgaggacccgggttcaattctcagcacccacatgcaactcacaaccattgcaactggagttccaggagatccagcaccctcagggagcacacacagccaaaacacaagtgcatctaaaataaagagaaattatttttaaaataataataagttagtaaatgcatacatacacacaccaaaaccaaaatttaagtcagcctgtcctttacccatgcagaaagctattcaaaacaaactggaattcaacacagtttcaaatacatttaaaattatacaattacctgtaaccttggggataggtaacatctatccatagacaagccctcaggagacagaagcaggaagatcaggagttcaaggcaagcctcagcttcatattgagttagaggccaacctggttgaattaagagcctgttttaacaggacaataaaaagaccaatgagatggctcaatgagtaagttttagtcacctgatggcctgagttgggtccctggaccccacatggtagaaagagaacgccagctcctcagtgttatccactgagtcccacgagtgcacacaaagaaggaggaaggccggagaaaagagaagaaggaaaaagaaataatgtacctggggcatggaaaataaaagagaggagcccatttgaggccactgaaatgtgtgctcagattagaaactctggccagtgtaaacagtgcacagaaaccacatagaccctgcctctcgtgcagagcgcatgtatcctgattagctgagggccgagccgtgagccttggcatttccaattgaaagtgtttgcagaggagaagccctggctggacactgagtgactccgtctagagttcatttggaaccacgccttctaagccacagcttccagaataattcatagagcaaaccaatgaagcagtcaggctgctgcgtttccctcagtgcatgccccaggtcataatgaatatgcagcatccacccttgagccctgtgggcattgcacagctatcgtgacagacttctgcagtgagccacgaacaaggcgagggaattgttgggtacataaaggaacattacagtgaacacagtgatttaaacgccttgtctctagagaactgtcagtctagttatatcattcggaccacaataatccagccactggaagtaaatgtgagtttctatctttacctcccgtacatgcctaatagtcgggttggttttgtttgtttgtatttttatgtgtgcatgttttttgttgttgatgctttgtttgtgtttcactacatttgtttgtttgtttggtgtgcgtgtgcacacatgccatggtattcatacggagatcagagggcaacctatgatcctcagttctctccttccactacgtgggtcccagggtttgaactcaggtcaccaggcttgcagcaagcccttttaccaccgtgccagctcagcagtcctttgttgctgttgttttttataaagcagttgtcagtcagctccaacagttacaggtgtgactatggcccaagtgccagggtcattgatagaatggagtgtcatttagaaagagtcccttggagaaaagtgctcactctcacatctctcaagcattctgagcctaggagtacagacacacttggctaaaggtttctcttcacagagctgacgactggcttgtttctgtgcctgcttctcattctatcctaccttctgtggtggtagaaccccattagaagagatgcagagttaaaagtcttagaataggaactaaaatcacaagttaattaaaaaaaaaatctgtctccaatataagtcaacaatctttaaagtgccctgattaaactaactttattttttaaattgtcgtttgccttttgccctttgccctttgccctttgccctttgccttgagtgcgctgctttccagggactagcagagtagaaagggccttctctatagtgagtctccgatgggtcaactgagaaatcacgaaggccagtggtagcaatggtatcctgctctgctacccccagggtagaaggtaccacaggcatggaacctggactaaggaccacagagacagacggtgtccgtcactggacatgtcagcactattcaccaaacacacaccattttgagacatctccaggcacatggtgctgcctgcaagtctgttggctacatggtcacatgacccagccttaggagaaaggttttctcctttgaatttctttcagggtacagtagaagtggttgggttaaaatatgatcattaaagatctcagtttttactccccaaaatgttcataccaatgaataaagtggcattttaattaaaggctcataactctccaagaatatcccaggggttgaacttaagtcactctatgggaccagctttagaaagccacaccatccttctgggcttctagtagcagcccagattccagccagctggcttctccaggcagggcctcttctgacccacatagcactcagatccgcagtctcacaacccttccacaagtgtggggaggttctggttggagcaggcagccatagctatgccattgaatacgtcacacatacacatgactaggactctaggaataaccaagagaaacttgtacagaggcaaacattgagagcctcgtgccatccataacacgggccatggaacagtgagcccaggcagaagagaatcccaatgctgtgacagggtgggcacagctgtggggagagtgtgagtgcccatgtgagcctgaggctgggactgttgcaggagtctgagtacagctggcactctgcgctttaagcccccaggatacttcaggcaaagccaggcaggacgaccgtttcctgcctccaaacaagccattccatgagctcagcagtctgctggatggtgtgtcgccaaccatgtaacactcaccagtctcttccaaatgtgctgaggtttgggtcatttttgaatgagggactctgtgtaaatgacatcccattctgcaaatggcactggcaattgagccgctgtcatagctgcaattcccctgctgccttttccccagtcttccttttggtcacaatgcaatcatgctcagggaggtcctgaccatggaggcaatgtggccaggacacaggaactcctgcaggcctacagacatgagcttcagccttcagcctcaattgctcctcttatgataggatgctaagaagactttctcctctctgagctttaattcttaactggctggataaagttatacctttaatcccagcattggaaggctgagactggaggatcaggagttcaaggccagcctaggctatacagcaagtttcaagtttcaagccagcctgggttatatgaaaccctgtctaaaaaaaaaaaaaaaaaaaaaaaaaaaaagtgcaagcatggctcaagaggtaaaggaacctaccagcaatgctgagaatttcagtcagctccatctctaggaccctcgtggtggaagagaagagccaatgtccaaaagttgtcctctgagccatggaacatgcatgtcctcgcactctctctaagtaaattaataagtaaataataaataaataaataaataaataaataaataaataaataaataaatgtaatttttaacatttaaatcctttaaacaaaatcaaaatctaaaaattaactgaagtcccacacaggttaggcctggatcacagaaaatacctttgagatgacatcagcctcatagccattttgttcttcgagtcaatagttaaaaccacagaaatggcatttgcagttgaggggcttggggctatagcccactgggtaatgcttgtcatgcatacatagtaacccatctgtaatcccaggactccagaagaggagacagggagtcccctgagcaagctaaataagattacccattgagaaactagacaacaacaaagacgacgcttgagccaaataataataactccaaagacatcagctttcctctacagagtccctttcttccttttcttcctttttaaacccataatacaagggaaagcagacaaatcagggtcgccagcctctttaacctgtgtctgggataacaatgaacatatctgtgagttgacacaacatgacaggagcagtccctgtcccatccagcacaggatacagacgtggctcactccatatctgggtttaagatacaaccaggtttggggaatgacactgatcccccaaccccaagtagaggggccatcacaaggacagaaaggttttcaccaacctcgtgctgtacagcttgccgagcaaggatctggatggctttgatgccatgcccaagtctctgcaaagagaggctgacccacgtctagaggcaggtgaggatgggcctgtacccacccccacaggagcctgcagtatggcagccacacccaggaggaggagaatgggaagcgagggagtcagatgtccctcttatacaatatgaatggggtaatggaatactgtacttccccccacggatcctactcttggtctttcctggctctggggacctcaggctcggctgcagggacatctctgaagggctgtgaggacccctacccacttccctcagccccactgactgcaagaccctttgcctgagcacacggccacaccacaccagaggaagaggtaggggctaggtaagagatggtggtctgccataggaaggcataggcagaggggcaaccaggataagagaaagacccttttccctggggactcgggagactctcctggcacagagaagagagtaagacagggcaggctctacataccaaagccacctgggaccttaatagctgtcatccatggctcccacctcagcctcagtctgtccctctgcatccccccggacctatgtacctgttctgatagttgttctgggcatctggccgcttttcctgttcgctctagtgggggtgcatggacaggaagaaagctgagggaccttgcagctctcagagctctgagaaaacagggcttgggtgagaaactcaagacccagtcccaccacaggccacttccctggtgagctgggactcccacctgctcttcattaacttgaagctggtgcctgggaagaagtgtcctatgtcctttggggcacacagcccctaatttgtattgtatcttgggaaaagtgaacgagggcaaggacccccatctcctttttctctgagtccctcggggactgcctcttgtgtgtttgtgctttcctgcgtttatctattcccgccccacccccctcactctggggggtctcccttttacagagcgggaaggagtgtgttctcggccatgaaactcggcaaaactcggtcccacaaagaggagccccaaagacaaggtagggaacgtggtcctgcccaccattcacacagctgctgcagccacttctttgaactgtcacaatcgtttaagcccgccctagactgagcacaaataatcttctttccccattggacacttgcacagccactcgggcagggtttggactcccgttggctagtctgcaggttaggagagggaggcataggacattgagcctctgccaggtggatggatgggctccttctccctacattcagtatttaacttcacatgaacccagggatttaaaaaaaaaaaattaaagctagtagcaagaatgcagcatgctgtgctgtgcctggctgcagcagcagacctacctcagagaatggccactgggcctggcaactggaatcactgctaagagaggaggctggaagggcacctgacagccgttgttaaggggaggcaagaaggataggtgaaagataaggggatgtgtggggtgtagtggggagatatgtgcacccagcatcggggcacgcctacgtggcttattggccctagaactttctcttccctagacagttttggctgcactcttcctagatggagggtacagcttcctgctgaaacccaaacctatcatatctgcatggcttttccaaatcatgctctcaccccactggatccatacacaggggtgcaggcctgagctctgcattccactgcggacatcatcacgaataaattacttcttacacctcgggggtaaaaagtatctgaatgcaataatgcccacgttgatgggtcctagctacaagagtgagtgagtgtgtgtgtgtgtgtgtgtgtgtgtgtgtgtgtgtgtgtgtgtgtgtgtggtatttgtgacctgcatcagtagccactccatttaaaagcagccactgtgatgagctgtgtgtaataagctcaggatgttttctactttcttccacaaaggctattcagagcttagagaacacagttaagtaaaagaattacattcggctaagactacagaagaaaataaggctagacataatggcaattaaaatgttttaaggactaagttagaccctggcatggccatgcgcatctttaattccaagacttgggaggcagaggcatctggatctctgtgagtttgaagctagcctggtctacatagagagatccaagccagcctagctacatagtgagaccctgtcatggttaggagagcatgacatgtattctaagcaagtgccatccaataagccagaaatgtaactctcctgactagaagacagtccccagcccttcctccacccacctgctcttctctccttccccagatgagccagcagtgctggagatggaggacctggaccacctagccattcagctgggggatgggctggatcctgactccgtgtctctagcctcggtcaccgctctcaccagcaatgtctccaacaaacggtgagtgagccagaggcctatatcccgcctgacaccgccctcctggcctgaatcccacctatcactgccctcctgagcaggacccacctgccactaccctcctggcctacatcccacctgccaccaccctcctgagtgggactcgcctgccaggcttgaaatttgggggcagataaatcagggcctatgggtagcttctttctttctgtccttgcgtgtcctctgagctgtctccctgtagaggtaggggtggatcaggcccttgagcttctgtgggtgaagggacatcacagagctgaccagtccacatgtgactctgttcacccaatggccataatcctgttgcttttgtctttgcttagtcttctctgttggtgccactgaagacatctaccccctcacccccgtgcacccccagttctgttggcagaactgagtatatgaaagtcacaattttgtccctctggcctttccatctctcacaccaacctgacagtacattctcctcctcaggtctaagccagatattaagatggagcccagtgctggaaggcccatggattaccaggtaggtgggcccaggaatgtctgagccttacagattctgctggagtgtggtgtcccagccaggtgtgtatgagagagtcggaggtaagagccagggcatcctagagtcacatctgaggatagagtctcaaagaaggcatctgtctgggaggcatttcccagaagcattaaggcaggcaattcaaaccaaaagaagaatgtgaggtctctgtttgcacagctcagagctccttgaagattctgcatccattgttgaaaatcctaaggaaaggggatctagaaaaacaatacacacacccacatgcacacacgatttttgaagaatgtttggtgtgttttaagttgttaaaactggaagtaacatcaatccggtttttcttctttgtgtgtctctatatcttcttagattagtagttctttgtttctgaaactaaattttaaaaggctctgaccaggggggtagccatactaccggcaggacaagggctcggcatccctggtggctactgacagagacttcgatggcctctgctttgcaggtccagaccctcggtcttggcttttctctcagcctgaaatcagagctatggtgaagggctcacaataaacaggtgtccaagcaggaaaagccttgtccctatgtacaaagtaagaagaaaggcgagagaaggcatctctcaagacaggcccaggcagccaccatggctctagactcccctaacagtaaacatgacccagttagatatcaaaaactgttgtgagtatagccttattctctatgcccatttgccaggtcccatgcacactacccttatgcgtgaacaactgcaccgcacctccctcaggagatgatataaaggtctagagaacccccactgaaagacaggcctggccacgtttcctgaggcttcaccttgactcccttcatgcttgctttggtttggttccctccagtaacctttttctgtgatatttaaaaactagccccaagtcatgtcacatgatgccaccctgtgactctagacaacctcaagcctttgagtcctgtggaggttggggaatgttgccccctgccctatcaaaacccaaacacaatgtcctgaagcattaggagacgtttccaggaggctgaaacctgggtgtgggatgcttcagtgtgctgagaccagggaaatcccagagaccccactcagatcccgtgccactggcctgctgtgcaaaagcacacaaaactgttgctaatgaaatttatttcttaaaggcttattataaagcaggcactgtactaggagctgaatatgtttccattgagattatgtcatccttacaaccatccaactgtagtggttactccacttttacagtaagacataaaccaagagttacatggccaccaaccacaggtaaatgaagcctggaggtggagttcagagccacagcaggcagagctgcctgttctctgcaatggttgctcccttgcttgcttagctcagtacttacatcttcctcccaaactgcttcctgacagggacttttgtgtcccagctcagatatgtctacctctaaagacttttaaaccttctgacttgcaccaggtagcccatctcacctggcagcgctgtgtctcctgacaggtccagccacagctcacccatgcgcatttatccaccgtgcaggagggagcagagaggattcaaatacacagtagttccacttccaataaatacggtgtacaaatccataaaaccaactgcttttctctcctttgaggaacttggcttcaattagtcagaaagacctcaaaaagtgtgcggcaatgaagaagggtgaagagaagctagcagaacccaggtccaggtgggattctgagagccaagccaattgtgaaggagtgggaagagaccccacacgtgtgcagcatgctggggacagttagaacaggtggaacattattcttctttcctggttattgacatcttcaagggaacacgccgctgtcacctgcctggggacgtgtgcctcccccagctctccttggagcacactcaggaacctggaatctgtctcttgatctctcttcctgagactaagtcttaacatcacctccaaacagacctccagtttccagcatcactgggtctcccaggccagacccaagccccacccccacctctgcagtgttcctgcattctctccccttggtctccttgtcttcatattgccccatccactctaccctccctgtcaccaccagagtgatctgcctatctggtcatgtcatacttctggccctggaggcaaggggagatgaagacctctgtagaactgcagttccataggtgtgagtgggcctccctgtcccttcgtccttctagcttcccctgacgttctgatgcacgcatgaaaagaggttccccaaagcaggtcacagggcaccattatttgtggggtccttcaggacatttgagtagttccccccaccccagccttgttccttgctttggaaaagactcttgggaattctagcccttgcctcagcaggagggatggtgagttagccagaggggccgcctggtcccaaggtcctacctgtggctccctttgctctctgggtttccatcctggaaacacggtgcatgagatggaagtttctttgcaaaatttcctgaaatttttaattgactttgtaaattgttttctcaacattttgatgactggatggcccatcccctcctgccaaaaatagaagatgagtgcattctaacgtttaattacaagtgtcacacacatacacccctgaagtagcagctggggaagccatggaagtttgcctcccttctaccccagtaccacgctcctcacctctatctcacacttccaggcttcccctgggaccactgtcatctagcaaagcgcatcccctccgatgtttgttctcccatctcttcattccttcccgccctccctctcctcctcagtacacctcccacggctactgtgagctcctggctgggtcactgcagccagctatgctccgttgcagaagatgagaagatgaaccctgaacagaggagggggcaaaagatggaatgtgtaatgcacacataaaaaccaaccaccttcttggcatggggaatttactctcagctggcacatctggccaaaacagaggagggggcaaaagatggaatgtgtaatgcacacataaaaaccaaccaccttcttggcatggggaatttactctcagctggcacatctggccaaaaccacacgtgtctgtttcccaggcctgagttatagcaaacctcttccttttgagggggggtgggtgggtgggtgggtgttaaatgaatttttaaaccatttgcataaaaaggtttatggatctggagatatagctcagtggtaagagcacggactgcttgctcttccagaagacccaggttcaattcctagcacttacatggcagctcacaactgtctgtaacccatttctcagtgatctgacaccctcacacgacacacatgcaggcaaaacaccgatgcacataaaataaaaataaaattgttaaattgttaataatttgttaaattgttaaatttgattgttaaattaatttaaattgtttaaaaaggtttctggaagttagaactctatgcactactgtgcaaagaatattccagaaggactcctagtgtctcttcacagtaaacttctcggcgctaagttaattagccctgtttcctttttggctccctgaagaaatggtgactattgagactctttcaagcgtggattctaagcattccccggcccccttggcctctcacatcccagaatagaagcggctgcacacagagttcaagtgttcttctgctcacggccccttctgtgtttctgtgccttcttggcagtggtcttattggtgttaaggtttctatttttcctagcatcgtttctgatgcgtggatttttcttggtcttcaagctatttataagaccttgaggaacacagtagatggtaattttagtaaggattctttctatctaaaaggagaaaataattctcctgagtaaaatcatatttagaagttgcactgaagcataacaactgaagtgccagagacccagatgagtggcaccaccagctgcccttacagcccagttagctagcaggaagtgctgacagagccaggaggctttgggtggaaaatgcaagttcaagcatcctgtggagcaacctgaagcatccaccaaccttgcctcctcaagagatggtccctaggcggggtagcttctgtctaagaggccacctatgcgctgtctctcatttcatggagttttcacctgtgatgtgctttcggacctgcaccatctcgcttaaccctcactggacagagactcagcttggagctgggggtgtgcagctcactgaacccacgggatcctccacatccattcctgcacatctgtcaggctgaggctcagttccaagaccagcaacccaaatctgtacctgcctgtattttgccatggccaccctaatggggattaaaccctcccccaaatccaaggcaggagctaaaggcttgaaatggagactcaggaagaataacagttgtctcaaaattcacactccttcctccccttcccccttctccccttcctctcccccctctcctcctccctttcctgtctgtctgtctgtctgtctgtctgtctgtctctcattctcattcttatattttcagttttatatatacatataaatacattttacatatatgtgtctttatatacatccttttgttacacatatctttatatgtatgtgcatataaagatataatgtatcgcttgtgtatattataagctaaaatatgtatatactaattttaaacctataagccagtaatcatttatcataagatctttgaggagcagagggtttattctgacatctcctgtgcctgtccacagcaggtgtccctaaatatttattgataagctagacagctgaaacagggcttcccagggtagaagctaaaggctgcagaatgtcacagtagaactcacacaacattctctatgcaggccagaaggttagactctggcaactcaaagaaattcaacagagggagaggggactggaacatgggaaagcgcccagcttccagaaagccaaggacatcttagaggttagcagcgtaaacaagaaaccctggacaggacccaaagcacgttcagggagatgggagcagcttggcttgtttaagagggtagggaacgggtgaggcaggcttcatggtcccttagcagagccatggcactgaggagaacttggaacccaagaatcaaccagaatttttaggggtacgttgtcatcttgtaagttcatgaagaatcactcaatcaagtttcaaaaagaaatcataactttttaggaatagtttactactggcattacagcatccatggctgaacgcgctgcctgtggtaggctgggcatgcctgaccagccggtttaggaaaactgttgctggacctgtctttggcaactctggcaactcagatcaggggtctggcctgagcaccaggatctggtaatgtttctcccttgggtgatttggtaacactggcctaggggtcaccagcctctcacttttcttggtgcagatatcccaggatcacctaggatatcagaggccgtagtcaacatggagcctggggtctcactccaagctggactgggtcctgcagttcctagccctgctgcctgctgccatgttccaggaagactagactctaggatggctgcattactcggtgtatcccttctctccctcctgcaggtcagcatcacagtgattgaggctcggcagctggtgggcttgaacatggaccctgtggtgtgtgtggaggtgggtgatgacaagaaatacacgtcaatgaaggagtccacaaactgcccttactacaacgaggtcagtgcccccatgacttaaggtgggaaaggggcgtcctgacaggggaacaggagcaactaggagttgagacaacagagccaccagccccaaggtcttgacccaacctcttacatcccagcacactgcataccacaacctctgcacctcctcatggaccccagtctggccctgctgtagctacaagtcaaccatgaactgctagcaatgcccgtgaacccctcgtagcagtcactgttgctgtccgggtctgaacctgagggtagcacagctcacaccagtccagcccaggtgccactggtaccatgagtgagtccttccaggtactgaatctctcctacacctatagatacatcaatacccatcatagggatactcttgcccattccacttgcagggacactgagactccagggccttgctgctcatgttgtgggtatcttccctttctactatgctcccttcttggtctcctgagcccctaaaaggcttctctccagaacacaaccttgacttcggctgtgagaaagaaaatggctgctgctacctccacttgagactccctgggggtgaagggtgaggggtgagggacctcagagacttaatagtttgatctccccattttacagaggagataactgaggcttcaggtcagaaagagccttcctactgtccccagggagctgtggatgggataaagcccatattgactgctgggctccagatggaatcccatcatgattggcccttccctgatacctgagcacattccaactatctaaaagcctgggtgtcctgggcttcctgtcctagagggagtacccagtctatctacctcagtgacttcagttagcaaggaggaccaagctagctctagccatgcatccatgtcctgtgccctgcagtgtagaaagagctgaggatgcccttgggcagctgtgcaccgacaggacccaggaacactcctgtctaagcttgaacaaacttgaacaaactcctgtacaaccacagcttactgtgtgtcccactggccccggggacagaacagtactgctcaagggccctccggccctgagtggaatcaggatatccaacctagatatctctgattttatatcaggacacattcctgactggaaaacctctgttttagacaagggtccactttcctctgataacaacaaatcccagtggctctctgtggttatttcataatggtgaagtcacacttggctgacttgggaggtggtggtcagcttgcttcagatctctgtacttcatgtttcagtcaacttgcttttatgccttccaatgtagcttcccagctctgggctcccctagcaaactcctattctctctgcagggacccatctcaaatgactttgccattgagtaccctgccctgccctctctgagtcagaggtcagcatcctctctgtaggcaaaggttaagaaacccgagtttagagaaaagagacaggaacagaatcagggctacttggctttatgcaaaggagcacccccgttaccaggatgagctggaagttggtcagagatgatccgaggggaggggatggttttcagctgtgctcttcaactgcggttggttttctgtgtttctatccctgggtggataaggggctgcaggtctcccctaccactctctcagctcaaaatgccaatagcaagcctcctccctgtagcaactaaatattcgcagatgttggcaaatgtctcataaggattaaactcacccccagttaggcctactccactgccctgcattgctctcattctttgcagccccaagaattctaattcttttccttttcagtgaaaaacattgtcatagttagggtctttgttgctgtgaagggacaccatgacccaacaactcttataaaagagaacatttaattgcgggggagggcttgtttacaggttcagaagtttagtctattatcatcatggcaggagcatagtactggaaaagtagctgagagttctaaatctggattcactagcagcaggaaaagagagaaacattgggcctggcttgatcatttgaaacttcacaccccacccacggtgacacacttcctctgaggccacacctactcctaattctttcaaataatgccactccctatgagcctatgggggtcattttctttcaaaccaccacaaacatgcccccagccatgaataggtatggctcttggaaagttctctaggaagtagaaatctccctctggctgcgctagaacagcagaggctggtgggaaccatcaactgacttaacaaatctctaagcagttctgggaaagaatcatgctcaggaaatacaaggactgtgagtccagccagctcagagcacaaggggtcctggcccgggttagccagctcctcccatgggtctgggccagttcccacacctggcctgggagctcatcaacacaactttaagcttcctgggaacagggggcttttgacatttgtccttccataatgacctggccccacatggaccaacacaaagccccttctctatccacatgtgtggtctagctggtcactgggtgaccactcctcctcctgtcacctttgccatggtcccttcatcccaaaggatctagccatgtgctatgaccatcattctgcctttgccttttttctggctctttccttctcccttgcccatgtggcgctttactgcagactatcctaagcacaatcaggacaccccatggacacccaaggacaggccgggtctgtcagccatcacctaagcatggctttcctccgcttccaggtggatctccagagatctcacatcctggtgtgaaccgtccccatcctctcagtctctgtcacatccctgtcacatccttcatctcattgcccctccttcccaggagtccccatgacactctcccagttcacggtctctccagaagcttttcccaagcttcctaacttgccatgactttcttgacccaccaagaaagtctgctgcttcctagagccctgtctagagcagtcttctcctctggtactcttctcagtgtctcctccatcccgcagcttctgccaccatcctcgtgctggtgcttcacttccagatctaggaccccagagctgcagaccctcacctcagccaacacccctgagacttaccagccatgtacagtgaacatttactgtactcttatcaactgcacaactgagtcctgtcattttgattttatacccatgcctccctggttttgtgtggtcatgctcctggagtaggagggcatggtggcctaatgtcactatccccataacacaagggtaaattgaaaggaagcgatgacccagcagttaacagctagatgccactggctttataggcagcacatcagcccacagggcttaagtgttagctataaaataaaggcatgggggttagagaggtagctcagaggttaagagtattggctgctcttccagaggtcctgagttcaattcccagcaaccacatggtagctcccaaccttctataatgatatctggtgcccttttctggcatgcagacagaaaacagtatacataatctagatagatagatagatagatagatagatagatagatagatagataaccatatcacagatttaaacaggtttttgacagtgactattgactactcggggtatttactctaaccgaagccctgtggtagcattagactcttcccttgcccacaagttcatcaaagcagcagtaactgtgctcactgcccacaccctttccccatcctggtgcatctaggacaaggatggggaccatgagtgagcatgggatctcacagcagatgagaacaatgcacagagccgcacttctcttttgttaccaaggaagtgctgtctctccctgagtgcgtcctcctgagacccgctgagttttatctttgaacacttcctgggttggggtgtatttcccaggtagcacttggtttgctggttatctgtatgccctttcacaccgtggtgtgcctcacagtccatagcctgcttgatcctgtaacatgatgctcgatgtccacacccctatgttacagttctctgggggttatgccaaagaacacatgtataagtctatactacaaaaaggacagaacttgcagagggctcagatttgctggctccttggtcggggttcttctacacacagcctataaacaagtactcggcttttgacattgtagcacaacatcatctacaaatatggtgggcttcctgcaaaatgaacacaagtagtaagaagacggttccatcccctggtaggagacggggccctactcttcacccattccgtctctcagaactcagtagctcaccactactgcccacatgagctttgagcctcatgggaaatgagggacacaggcaggcactgctcggagggaggggccgccagccacagcactctgctctctctcccccccagtactttgtcttcgacttccatgtctctcctgatgtcatgtttgacaagatcatcaagatctcggtgagtggagggctgctgaagctagtgggcaggaccacactgactaacgcaggacctcagcacggccctgtaatgtgctgttcataacacagcagccctatgcctggatgcatggctggccaaaggggaacagagaatggatattgaccccctcttgccccttcagctggattcctctgtaaagtgtaaaacctactcatatatgtaacggcattggggggaggggagcatggcgttgggcaggagaggctgatgctgagctttcagcaaaccagccctgttccctgccaaataccttcccactttactaagaaagatggaggtaacactatctatcatcagtgggccctgcccctgcccctgccccttcacaccccatccccaaaggctactccctgcagagcctgactggctgcttgtgattctgctctggaaggttatccattctaagaacctgcttcggagcggcaccctggtgggttccttcaaaatggatgtggggactgtgtattcccagcctggtgagtaacccctcaagaactggctcgtgcatgcagctccagaacatgcttgctatttggctcctggcatccatcaaggagcacagacacagcccactgtccatgagtagggcagccacgggagtggcagtgaaaccgtgtgcactctacacacagatgtaggagtcgtgtgcgccatgtctgataggtgtttgctcattatgggggaagggacctgggaataacagtacagagaggtagctcaaatacacgtggtacaggagaacatcacctcccctgtgtcctatgagagcagttatacagagggcagtgagagccctggaggggccgtgcccacccactgcctctggctggcacctgctgagcagaaaagaccctgctgtccttacaaaatccccatcaccccctggcagttaagaggcctgagactcacagatgtgccagggtttggcccagccaatcagctagtcagggggataccagggcatgtggtatccaacaagtgaaccacccaatctaagcgtggtaacaaccaatggcaagtgtaatgcacaactttggggcactctgggctctaaaatcgcttttcacaagggaccccagttaccctaggagcagctatggcaagaaaggctgtgtctgattataattccacaggtacctatggccagcgctgtatagagttggtatgggcaccccaagagttggtatgggtaccccaagtgatggtctagagcaacagttcttaatctgttggtcgggacccctttggggttgaatgaccctttcacagaggtcacctaagaccgtcagaaaacacagacattatgattcgcaacagtagcaaaattacaattataaagtaacactggaaataattttatggctgggggtcactacaacatggggagccatgtgaagggtcacagcatcaggaaggctaagaaccactggtctagagggcttgtcactaagtggccaacttggggatatccatgtccctgaagtgaaactactcagaaatcaataattaccctacaaggccctttgttggtgacaatacaatctcaatccaaattgtcacatttgacataaatcaattaaataaataaatcataaatcaattaaagacacagtaacatcccttcagctttacagaggagccaatgagcagagagaaatggggaggggcttggaggagccactcagaagtaggtgaaacagttggcattttcttgtggccctaataacactcagctggtgcccactgtaacagtgacttgtatcaggagatgtgagtctaagacatgaactcatgggtcaaaccattccagatgtgtgagacctcaaaacacctgtaggctatctgtccagatagagagctggactgggggtgtatctcagtggggtacttgcctggcatagccaaagtgctgagttaaatcctctgccctctataatccaggtgtggtggcacacaactataatcctagcccttgggaggtagaagctggagaatcagaagttcagggccattcttagctatatagtaagtactgtaactatgattcatgaaaagaaagaacaagccgggcgtggtggcgcacgcctttaatcccagcactcgggaggcagaggcaggcagatttctgagttcgaggccagcctggtctacagagtgagttccaggacagccagggctatacagagaaacactgtctcgaaaaaccaaaaaaaaaaaaaaaaaaaaaaaaaaaaaaaaaaaaaacaagaaaagaaagaacgatggataggcccaaggtgataaggagatttaccttaaagtaagagggagagcctgttctgatacccaggccttcccacagccccgtacaggatgggagcctcctgggaagcaatgagctacactttgctacattgcttcgcaggagacaagcccagccgtgcccataggcttgagtgctgccagggtctctggagatggtctcctcgctaggccaagcatcagcagaccttcagccaagatagagtgggaacttagtatgtgcccacagtgattgagttctgattgagaaactgctgctgagggcagtggtggagtgccccctaaatcccagcactcaggagacagaggaaggaggatctctgagttcgaggccagtctggtctacacggaaaacgcagctgttatggaggaggtgggttcagacactggacatgttccagtaggtctaacttctcaatccatgtagacgtggttgttcctgtctgacagtaaggaaatcgagactctccaagtccaaaactactgtggagtaactgtcagacagaagttgagctcaggcctttgtgggcctctgcactagggtaacccactcccagacttactgctcctcccggtaaccttccagaggcatggccaaccttggcttgattgcaagtgcaggaaattgcttgctgctgccctctgctggagatgagttgtagttgccgtggccagagctaccctttccttggtcgcggctctccagttgttcttgcttctccagctggagattgcagcctccagacttgaggcctcagagactatgaacccggtgtgcatcccacacaaatgcccctcagctgcatccctgaccctcagccaaccagaagtgggacactcacacccaactctatttcatgtatgtcagacccaaatctgccgcctgtattttttgccacctataatcttcagccatgttttttcaggtttatcttccaatagcttttgggtttaaaggtaaattctgttttgccagaattgtgatctttccttgccaaattcactcagtttcacccaaccatgtgcatgccttttccatctacccactcatacaaacatccactcctttgtccacaacataacagaccctgctataaattagtccacccaccatctatttacccatacattcccaaggccagcgggcagccacactcagcccttgtctgtctcgccagctccttcctatttatatctgctcagagccatgaggtccaggaaactatggcaccctcctcctgaggccaccagctcatcagaggggccccagtgactccaaacactaaggtttcctggcccctcagcacccttgactctcagttgacactgctatggccatgaccgtcgtgacagctgggccagccgacccacacacacacaggctgtattctgctcccttccccaacctcaactcgagggtgccactgggctcagaaccttggaagacacaggtgggaagggaggggagcggggtgagttctgagcccctgcagatttcaattcctgcaggaaactgttaagcaggtctccccacctcgtaccttatcactaactttaaaatcaacccagtggggacaaatcttcctaaaatgcctcctttgctgacacttgtacctttctctacactgtcctgtggcctggggacaccagaaggcacactgctaatctctgcaccagtctcaacatggagacaggcattgcgtaggtgatttctgtggtggggggcatgcacacgggaccctgtgagcactgagaggtcagggcctattcctctgaaggggtcaggggacgctgcatggaagaggagactcttggataaaatgatccgttttccagctaactaaggaggaggaagaaggcgaggacattcggagcagacacaatgacctagagtttggctctgtgtaagctcaggaagcaatgggtactttgcctggacagtcctggggtggtgggaccaagcagggaagagagtagcattgccacatgtttggcttcacctcaagacacggagagactcagaagggctgaaaggaagaacatgataggtaaagcctctattatagtaggccctatctagcagctatgggggccagctgtagcagggaccacagcagagactgcaagctgtgaaactgacttggaagcaattcggagtcctgacacttgctcctgggcagggtctcgctcagccctctgcctgcagaggccctctgtcttcactggctgaatgcaaccagagccatggccttgagtctcctgagcctgcagccttgagcttgcaagccctagcaagcactgagcttggacgccctgtggaatcctgggatagatggtaaatgcaatgcccttccacctctgcagaacaccagttccatcacaaatgggccatcctgtcagaccccgatgacatctctgctgggttgaagggttatgtaaagtgtgatgtcgctgtggtgggcaagggagacaacatcaagacaccccacaaggccaacgagacggatgaggacgacattgaagggtgaggctccatctcccctagagacctgaacacaaagttcccccaaaggaagcttgtagagtggtctgaacccagaattcttaccattagcccccttacttccacacttcaccctgccagtctctcctctggggcccaaggcaatgtggtcaccggggttaatggaaggtagtgctttgacatctagacttccggctgagaaagctggtgggaagaagagatgctggcgactagaagtcctcctgctgccagggtccatgccatgcactcagatgagatgtcactcagggcgccaatcttgggccacagatagtggctgctgagaaacactctgggacattgtctggactctcagaacgtgcctgggcctggtcttccatgggctgggagaggagacagctcctggaagttcttgtctcagggaagacacagagctgtgaaagctgatgccacacttagcatcccgcattacagtttacaaagctctgtagcctatgtactgccttcctgagatgtggctgttagcatcaccgccaccttaacgaggaagaaactggggcttctccttctgttggaaagtgtttctcagaattctaaaaatggataggtgcatgaattagtatctttaatcatagtctgggtcctctcatgctgtccttcacagattatgctaagccccaggcagctgctaagatggtgtgtgtgtgtgtgtgtgtgtgtgtgtgagagagagagagagagagagagagagacagagacagagacagagacagagacagagacagagagacagacagagcacatatgcaagcattcacttgctttgtctcatctcctccctgtccaccatccgctctgcctctcctcccatcataatccttgcatagctcttgttctaaggacctaagaggcaaagagggttctctaagcctgtcagtggagatgacatgctgcctgtgctcataggaacttgctgctccccgagggcgtgccccccgaacggcagtgggcacggttctatgtgaaaatttaccgagcagagggactgccccggatgaacacaagcctcatggccaacgtgaagaaggcgttcatcggtgagaacaaggacctcgtcgacccctatgtgcaagtcttctttgctggacaaaaggtactggggatggaggtgctgaaggccgggatggtgggctcggagtaaaggtgagggatgggaggaaggggcagaccaggaggagtctgaaacccccagctggaaaacacatgcacatatacatgcacacatgcaggcacactcgcgctcacacacacacacacactggcacacataatatggcttttttcccaccagggcaaaacatcagtgcagaagagcagctatgagccgctatggaatgagcaggtcgtcttcacagacttgttccccccactctgcaaacgcatgaaggtgcagatccgggactctgacaaggtcaatgatgtggccatcggcacccacttcatcgacctgcgcaagatttccaacgatggagacaaaggtcagcagcatagcatagctgtatccagaggagaatggggcatgatgggaacatgactgaggcccctttccctcacaccacctccgaccccagccagacagggtttttaagggtttcatttgtagcccctgcctcaagaaaacagggacgtaataattcaaaactcctgggagctgcctggatttagcgattacctctgctgcttttgcacctgtttccccattgaccaactgaaaatgagagttttcatacagggaggtgcacgtgctctgtgtatgtgatctccatgtctttactggtaactgatgagaacagtgacacctgtctacaggcctgtggaactgactgtaacccagaatccaggaacacagggagacaaaatgccattcccgtgccccctaatacgtccagacagatagacatgataccaagtgaccagaacagcaggcggaagaaataaagcctacagtacagttccatatataggaaatacccagaagaagtgactccagacagaaaataggcttgtgcatccaggaacaaagacagggtggtcagaagcacctgctgaggggagtggggcttctttagggtggccacaagtatgacagggtatgacaatgggcgcacaacatactgaacatgcatacgatagccactcaaatgtgcactttaaatgacaagttctatatatgaactgtggctcatctgtttaatgctttgtttacaaaactaacaaataattaaatacagaagctagggaaatgggtcatgaggatctgagcttaaataccagagcctatgtttacgtgtgtgtatgtgtgtgtgtctgtctgtctgtctgtctgtctgtctgtgtatcaaggagtgatggcacttgtaagcccagcattagggaggcagaaacaggatctctggggttccttaaatcccagccagcctggccagcttgccaagctctaggccaatgagaaactctgactcaaaaaaaaaaccaaaaaccaaaaacaaaaaacaaaaatctgagattggccctcctatgcacacagggctcccatacatacacatcataaatacacacacacatataataaatggttttgtttgttcgttcatgttttgccatatagaccaagctggccttgaactcacagagatctgcctgctagaattaaacctgtgtgtccatatccagaatccgacaaaaataattgtttaaaagaaaatacacaaagaagagttagattcgcataaggcaagatttgttggctgaggcccaaccaaacctcagcatgagagaagagacttgtcaaagacagagagcaaggctcctctccagccctggggcctgttcagcccaccatattcacagcccagggtgcttctgcctcaaggagctgaggacccacaaataaccaagggaacacagcgaggagggaaggtcccctgagcaggagaggcatggagatggacatcctacattccgaagcagaacaaaacaggagaatccacgttgaggtgttcaggaagaactggcagggggaagcaggaccctggctttccctcctacacagggcctaggaagaagccagaaggcactctgtgtaggcacaagtgagaaaggcacccagcagacaaatatccttgagctcagcacccagaagccacaaagacccctgcatcctaggtgagcctgggatgtgacggcctttctacctctctcctcactgcttcaggcttcctgcctaccctcggtccagcctgggtgaacatgtacggctccacgcgcaactacacactgctggacgagcaccaggacttgaatgaaggcctgggggagggtgtgtccttccgggcccgcctcatgttgggactagctgtggagatcctggacacctccaacccagagctcaccagctccacggaggtgcaggtggagcaggccacgcctgtctcggaggtgaggacaaggctgtgtgtccagatccttcactccatcctcccctcaccatgcagctgagttctggttttcccccatcgctaccctgtccactcagagaccctcatttgacccctttgcaagacctcagtcctcacctactgtcgacctatgccctaccagagatcctgttttagctgccaccgaccaatggcaccccacctctgtctcgcttctcagccacagctgtccttgtatctgcagaactagccatcctctcaggaacaactagggtttgagtccagactgcctagcctcaaagctgggtaggacacaccccacctgtcagccaagagcctatctgtgacattaggaacctgacccaggcctgtggctcacaaaagctcagcactgggcttaactcccccacagagctgcacagggagaatggaagaattttttctatttggagccttcttggaagcctcaatgattgaccggaaaaatggggacaagccaattacctttgaggtgaccataggtgagtgctgagaccatagggaaggtttcattcaggcttctggttgtcagtggtgtcactgtgccccaggcttcagagagcgggctacattgatgtgtttcccacgactgtccacagacatccacgaagcagccctggttcttgggagtatacttgactgtaagagaggtcaatcagcaatgtgccaaagggtcagactgggactagaacgtcagaagaaaatagggggagctcccctgccatgccctgtggtggaagagagaggagaaatccagactatgccctgggctgggcacagccatcatcagagccctcccttagggatgacatggaatctttccctgggtggtgttatctgagcctagttctctgactttacttctccaagagaaatacatggagggtggtggagtgagtgaggaaaagactgcaggcctcttacaagttgctctttgtccaggaaactacggcaatgaagtcgatggtatgtcccggcccctgaggcctcggccccggaaagagcctggggatgaagaagaggtagacctgattcagaactccagtgacgatgaaggtgacgaagccggggacctggcctcggtgtcctccaccccacctatgcggccccagatcacggacaggtgggcatcacttgcccatcctcaagtggccttggcccttacctcccagatccctagacctcaacctctctctgcatcctgcccgccccaggaactatttccacctgccctacctggagcgcaagccctgcatctatatcaagagctggtggcctgaccagaggcggcgcctctacaatgccaacatcatggatcacattgctgacaagctggtcagcaaggctgcgggtgacaggatctgggagagggggtgcatgtacaacacaggctgtctctccagaggcttgtcttgaaatacagaaaggggaaacccacagggtcccagagctctaagggtctaccccctctaggtctgggctctcagaagcagcggggcaggccagctacttcaggtctgcacaagacctctctccagtcctcggtcctgctctgtccaccatggacatagctcagagtgcttcttcctgaagaagctgaggacccatgaataaccaagagtccccgtgtctacaactggggagttggtggctccttcataatttatatagaatggtccatattactaggttcctctttcctgaggtgaatgggaaagatctgggagaaggagggctaaggcccaaagtgcacttgaaaccctgcttcataggaagaaggcctgaatgatgtacaggagatgatcaaaacggagaagtcctacccggagcgccgcctgcggggtgtgctagaggaactcagctgtggctgccagtgagactgatggagagggcagggtgggacatggggacactctagacaggtcagggcagaggtggctaagtcctggctcttctacccctacccttctgcagccgcttcctctccctctcggacaaggaccagggccgctcgtcccgcaccaggctggatcgagagcgtcttaagtcctgtatgagggagttggtgaggccacagctggaccctgggaccacggaaaccaatgaacagagaaatctgtccttgaggtcatggctcaagctgacacccaaagctgaatgctcctcccacactcttcccaacaggagagcatgggacagcaggccaagagcctgagggctcaggtgaagcggcacactgttcgggacaagctgaggtcatgccagaactttctgcagaagctacgcttcctggcggatgaggtatgtggcctgagaaaagggcagcacagagaggctgtcccgcttctcagggaggcctctgccactccgacagcccttgttgacaaggttgagcaagcccagtgggagagaaaggaagacccaagacgagggtccttccttttcacgccccccagcttttcctcagctaggcccagctcccaggagtgaggttcagcaggctcagggtaccactctagtgaggtcccctggcttgtgccctcggccctccctctgctgcagccccagcacagcattcctgatgtgttcatttggatgatgagcaacaacaaacgtatcgcctatgcccgcgtgccttccaaagacctgctcttctccatcgtggaggaggaactgggcaaggactgcgccaaagtcaagaccctcttcctgaaggtgctgcgggggatgggccaagctcgagtgggtggggtgggttcctgtagcgactccgatgaggctggcaagcctaagagcaggaggtggagcccttaactagcaggtgttcgggggtctggagaccacctgtccccacctgccttccccccttagtctctcatacccagctctgtccggtgagggggtaggtgaagctctatctacctctgcctaaagcttcaacaccaccctgggcctcccttaccctgggagtcctggaaattctcaggctcttggtgaccctgagcctgcccctagctgccagggaagaggggcttcggctcggcaggctggacagtacaggccaagctggagctctacctgtggctgggcctcagcaagcagcgaaaggacttcctgtgtggtctgccctgtggcttcgaggaggtcaaggcagcccaaggcctgggcctgcattcctttccgcccatcagcctagtctacaccagtgagtgaggcctcctgatcctgggtgggctactgtcccagcttgtactcccaggggggccacaggggctgcaaggcatggcttagcccacccttccccacagagaagcaagccttccagctccgagcacacatgtatcaggcccgaagcctctttgctgctgacagcagtgggctctctgatccctttgcccgtgtcttcttcatcaaccagagccaatgcactgaggtgaggacctgaaggggaggggacctgagggagaggaaccctgggcttttgggagaactgggaggccagtactattggcctgctagttccccagctcttcagaggaaagtccttcaggtaattggctagggtagtagaggccaacagcttggaccatgtccacaaggcaagggagaccagcggggcactgggaatagacatcacaaaaggcttgacttggggatttctgggaaagtaggagaatcgatcattcctgcctgcagggtttcccagcatgggaacagtggctgccacttcttccccatccctcaccccatgatcaggttctaaacgagacactgtgtcccacctgggaccagatgctggtatttgacaacctggagctgtacggtgaagctcacgagttacgagatgatccccccatcattgtcattgaaatctacgaccaggacagcatggtatggtgggcactggcaccagtgacctctagcagaccctccccttgcaagttccccacctacccctgaagctctacacaggctgcctgtgttgggaaactgggctgctcatcgagctttccaggtgcctcctgcccacccaccacagtctgatccttttccagaaccatgagccacttggggaccaagtgcgaaccatggtgtttcccatctcctggataaacacactgaggccaaatcttccagagatgtaccaggaagccctggtacaccccaccctagggctctgatccctcactatgctcagtcacaatcaggggccatctccctgctttccatggagattctagagtggagaggaaagatcaggagaggccaacgctgcctacaagccaacccaactgttggggtgcccaagggaaccctagagttttgttgtgttagggcaaagccgacttcatgggccggaccttcgccaagcccctggtgaagatggcagatgaagcatactgcccacctcgcttcccgccgcagcttgagtactaccagatctaccgaggcagtgccactgccggagacctactggctgccttcgagctgctgcaggtcagggggcaggcaaagggggacagggctgggagtcggatctcagggggccttatgctctctggcctgcctattctcatgacaccaactcactgggggagggacccctctccctgggctcgccactgagatttatgacctcattcctcagattgggccatcagggaaggctgacctgccacccatcaatggcccagtggacatggacagagggcccatcatgcctgtgcccgtgggaatccggccagtgctcagcaagtaccgagtggaggtgcgtgagggctccatgcccctccctgccctgcctgtaaccttcgcccaagtcacccggtcctctcccttttgctccacgaagcaccatgagtgcccattctgtgagccgtcaaactcctagtcccatagggatgcctctcagtttcagaaaaagatacggagggcccagagtggaggggacttgtccaagatcactccttagtgacagcagcactgacacgggccccagcccaggctagtgctatcctgctctgacagagtcgcatcactgagcccagagccattctaggccctctgccttccattgtgatccctaccctcaaagacccttacctcggtttcctcaggacattcgcctcatgcagtctcctgacaccgtcctcactgtgcctgccataccagtctagcttctcctcccacccggttccccccagacaccctccccagccaccactggctccccttacagaaccaccctccccctacaatcaggtgctgttctggggcctgagggacctaaagagggtgaacctggcccaggtggaccgaccacgggtggacatcgagtgtgcaggaaagggggtacaatcctccctgattcacaattataagaagaaccccaacttcaacacgctggtcaagtggtttgaagtggtgagtgtaggagctgacagatccgggcggggctaggtgtgaccagtgtggtttaccttagccggagcctcctcagcccctttctctgagacgtagactgcaaaaatgtcaccactacccgtcaggacctcccggagaatgagctcctgcacccacccttgaacatccgagtggtagattgccgggcctttggacgatacaccctggtgggttcccacgcagtcagctcactgaggcgcttcatctaccgacctccagaccgctcagcccccaactggaacaccacaggtatggcctttacctaaagcccaggcctggctctatttggcttcttgaagggcctcgcctccaggtctagcctcagttctgctgtctggatgcacaatgacccacccttccctctaactcatttcccttcctcacgcccatcttgttcttctacatgtcctgtccctcctctgccctgagagacttccagaggagtccactgaagatcacgctcttcctgccttacttcatgcctctcactgtaactctgttcctcctctctgtctgtctgtctgtctgtctctgtccagtcaggctgctccggggctgccacaggctgcgcaatgggggcccctcttctcgccccacaggggaggttgtagtaagcatggagcctgaggagccagttaagaagctggagaccatggtgaaactggatgcggtaaggcgaggggctggcccaatgctggtcgggacacacgggcacaggtagcactggcgagccgggcaggcctgtcctgagagtgcagccctgtcttgtctctctgtgtacttttcaaaagccaaccttgatcacatagcactgtctggaggcagggtactaggggctcgggaagcagatgatgtgtacaggcaagccgtggaactgtaatggttagaggtgacgacctgcggcatttcacttcagaaacgagcccctaggtgatggactgcttgtgagacaggtatcttttggacagggccattttccatgccaagtgctgcctcaagttggcccttggtcacattagccaggtgacctgctcttctgaatgtgaatgccttataggcaagagcaaggggcccccagccgtgtgtactctcctgccgcctgccctttgcgggcgggggtggggggggtggggggggttactgcctgccccctccattagttctcagtggctaaccctgccctctctccttggttccttccctctgcagacttctgatgctgtggtcaaggtggatgtggtaagtgtgggaatcctgcaagggcttttgggtaaaataaccattccctgacaccaatgctaggccagaaggaccttcatggacccagccatccttctctgagtgccagtcctgccttggcctgtggctcctcccacaaagccttgccattggtggactcacagcagtatgggtcagggatggtactttctggggtcagatggccgcagtggataggaatcattcagggtcctgggaaaggatcgagtgtaggaaagccgacgggatggtcaacctggccaaccctcaggctgaagatgagaaggaaaggaagaagaagaaaaagaaaggcccgtcagaggagccagaggaggaagagcccgatgagagcatgctggattggtggtccaagtacttcgcctccatcgacacaatgaaggaggtgaggcctgggcggggcctggggataaggaggaaaggagggggtgggctgcagctgaaccagctagacatccacctcctctccagctcttcccctaaccctcagagtcagctcggcagctctcccttcagactcctccctcctccggttgatgggcagttcacctcctggcttagtccctctcttgtcagccacgtgttccacaaagagctctgacattttcatgatgagccagataccatactagatgctgtgtgagcccaaagataggtgccacaaaggccctgggcagctccagccttgtgactagaagctgaagacgccacgggctatggagacatcaagacctgggaagtcaggaaagccccttcgtgttttggcagcaacttcgacaacatgagacctctggaactgacttggaagagaaggaagagatggaaagcgctgagggtgaggcctggcccccagcatctggacccctaggtccttgcacccatgacaatacctgcttcttcagccctggcctgggctccaaggaacaggctaagggctgctacagtaggtcactctgatcagttcagcaaccatagcagccggcagacatggagatcaatagaacacctgagctggaagggacctagcttgttccacattttacataaccttttccatgggactacactgatactattctgaaaggaaagaggaatctggggtcagatctgactagaaatgttggtttatgtgagttccttcagagcacgacttctcagagcctttttttgccctattgtgatacaagtgtgtgtctctttgtgtgtgtttatgtgtatgtgcatgtctgtctgtctgtgtgtgtatgtgtgtctgtctctctgtgtgtatgagtgtgtatatctctgtatctctatgtgtatctgtgtgtatgtgtcagaatatatatgaatgtatgtctctgtgtgtgtctgtgtttctgtatatgtatgtctctgtgtgtctgggtatgtatgtctttgtgtgtctgtgtgtgtgtgcctgtgtctgtgtgtgtacctgtgtctatgtgtgtctgtttgtgtgtctgtatgagactgtgtgtctgtgtgtgtgtctgtgtgcatctgtgtgtctgtgtgtctgtctatatgtctatgtgtgtctgtgtgtgtgactgtctgtctgtgtgtgtctctatatctgagtatgtgactgtgtgtctatgtatctgtgtgtgactgtgtgtctgtgggtgtctgtggtgactgtgtgtatgagcctgtgtgtctatgtgtgtgtatgtctgtgagtctgtgtgtgtgcatattgtgtgggaacatcagtgcctgtgtaccacatcatgcactcagagctcagaggataactccccgtgctagtcctcatcctccatcttgtttgaaacaggctctcgctgtctctgtgtacaccaggctaggtggcctcattgccgctatgtacaccaggctaggtggcctcactgctgctgtgtacaccaggctaggtggcctcactgcctctatgtacaccaggctaggtggcccgggagcttccagggactctcctgtctctacctcctatctccccataggtgttctgggatcatacacactgacactaacttttacatgaattccggggttcaaactcaggtcctcacactcaggtagctagttattccaccctctgagccatctccccaagcactggtgttatcaatttttcaaagaaaatactatataaatgatttcctcgttttgtctacgcatgacaatagcacttaggcctggggttccacaggattccgcttgggaacactagtaggaagcagccttgttaacataaacctagagaaccagggcagcaggcagaggaccgagcagccacgggtgcctgactccagatccaactcctcccctgctctctctgtctgtgcccctgtctcaggcatgacctgctatctgcagctccttgtggaatgcattgagactccaaagttaaatgggaaaagggtggtggagctgggtctggggctcaggcccttcctgctctggcccttcctgccctacactgccctgggttgactagggcttccttttctactttgggccaggcctgaagggaccaatgaagagcaaggagaagtccagagctgcaaaggaggagaaaaagaagaaaaaccagagccctggccctggccagggatcggaggctcctgagaagaagaaagccaagatcgatgagcttaaggtgagggcctgggagtaggccttgtccagatgatgggtgggaggcagaagatggggcaggatgctggcctgaggcctgacagcctgtcctacccaggtgtaccccaaggagctggaatcggagtttgacagctttgaggactggctgcacaccttcaacctgttgaggggcaagacgggagatgatgaggatggctccacagaggaggagcgcatagtaggccgattcaaggtcaggcaaggagcatgacccagccattgaccccacaagctcatttccttacatccctccccactgcctctgaaatcctacactgtccatggtccagcagctgaagtgttaaggcctggtcacagcacgtacctgcgcccttggctagctggccctgtcctggtgaatctgcagcctgacagccccaccctgtgccttgctccagggctccctctgtgtgtacaaagtgccactcccagaagatgtatctcgagaagctggctatgatcccacctatggaatgttccagggcatcccaagcaatgaccccatcaatgtgctggtccgaatctatgtggtccgggtaaggctccctttgcatcccctccctgcaggcctccaggccgcctgctggagggactgcttcaagacattagaagaatccactggcttagtccccatatttctagagaggaaagtcagccctggcgacaagaggcagcaacttccctagtaccacccagtgagacttctgtctctaacccaatgcctctgtccccacttctcaacatcatgggaccctcaggagtggggtgagggcacccatgagtctgcttaggcaccacttaccctgcctaggccacagacctgcacccggccgacatcaatggcaaagctgacccctatattgccatcaagttaggcaagaccgacatccgagacaaggagaactacatctccaagcagctcaaccctgtgtttgggaagtaaggcctcaagctgccctctctgcccccctggccctccgtccagtcctcactccttgcccatctcaagctgtacccccttcctaacaccccctccatcaggtcctttgacattgaggcctccttccccatggagtccatgttgacagtggccgtgtacgactgggatctggtgggcactgatgacctcatcggagaaaccaagattgacctggaaaaccgcttctacagcaagcatcgcgccacctgcggcatcgcacagacctattccatgtgcgaggacagagtggggccggtcgctgggaggggctggggacagactggtgacaggggttgggaagggactggatgtctgctgcacagctgcatcttaacactaagacaagactccaggtggtaatttggaaaggtaaacatgccagggtttcagtcaggtgtgtgccttcacttcacactgagtgcagcttcaggagccaggcctgactactccacgataccatacagacgggattccatgacaaaggagtcagaatggggaaagaagaaaggaatgggacagggcagtggataaagaaagcccttagaggatctgggaaggtctctgccttggtcaagtcccctccttctctggttacctgatgcctcacaagagccctgggggggggggggcgttggttgggaagcactcgatgtcaaagacaaagacaaagtagaaggaccagcccccagcagccctagtatcttgggtgaagctgctggaggctcattgctggtgtcagcaacggccagttgtggaagagtagccagaaggatctgggatgtcccagcctgaaaggcttcacgcctgtgtgtcttctcccacccacagacatggctacaatatctggagggaccccatgaagcccagccagatcctgacacgcctctgtaaagagggcaaagtggacggcccccactttggtccccatgggagagtgagggttgccaaccgtgtcttcacggggccttcagaaatagaggatgagaatggtaagggacattggaagcagctgactggccctcctccggggccttcggtggggcttcagagagccacacttctctatgggggacttctagatgtcctctagtgaccctgtgctctgtgccccctccagtctgcccagcccctgccctcacaccttctcttgtatctcacacactatctcccctctttctctctcattcatctccatgggtggggaaaataacccattttacagaagagcaaactgagaccgaacaagttccagtttggtgacttgaccaaactcacgtatctctacagaggcagagcaatggtgtaggcccaggtctctcagacttcaagccccaccccatcccctacccaccctgttcctctctgtccgtgaggcacttcccagaggctggagaagggtctgtgctggagtacttacacctccacagaaggggtttctcctccttggtccctccctttcacaacacatcaggggtctctgttcaacttccctaagcctggtaagtgggggtcatgggtctctctggagccagaggtgtagctgagaccttggccctcctcagtgtctgtctccctagcaataaaacaaaggtaaggtagactcggggctttgtcacagctcagagctttgttctcctaagcccatggcccccatctagagcccctggttctgaagaggccaggtgtatgcacctgatccactggacttcacaggtcagaggaagcccacagatgagcacgtggcactgtctgctctgagacactgggaggacatcccccgggtgggctgccgccttgtgccggaacacgtggagaccaggccgctgctcaaccctgacaagccaggcattgagcaggtgatgtgcacacggctgcaatcctaaggatagaaatggggttcacaatattccctgtgtcccctctgtatgcccacataccgccccactggggccaacttgaatggcaagagtggttctgagacccacatgagactgttggctccccaccccagaagctgtccccggctattggtgacattataagacatcctagcatccaaagctagaaactgatggcatgcacttttagctaggccaggagcagaaggaaaaaacgtcactcagacatctgtcacacccctctcttcctcagggccgcctggagctgtgggtggacatgttccccatggacatgccagcccctgggacacctctggatatatcccccaggaaacccaagaagtgagctgcctgggcacgggcaccatcccctcaccctgtcccatctacttcccaccacagcctagactgtccttcaggcagaaggcagcctggattagtcactactccagggcctcaggtgtgaccagacctgctctaagtggggcactacctgctctgcccacagtgaatgtgatgacccacaccccggcaccctcttccacatcatagtatccccctcacaaagacatagccacccctcaaagccacctgcactcacaactctcccctctcctctcccctcctctcccctcctctcccctcctctcccctcctctccctctccccgcctctccctctccccacctctccctctctccctctcccctctcccctctcccctcctctcccctctcccctctcccctcctctcccctcctctcccctctcccccttcccctccccctccccctcctcccccccctctgtctctctctctcacacacacacacacacacactcctactacaggcacgcagaagaacctatcagagcctattctgtaccactctcacattttaccagcctttcttctgggtgactgcctgaaaaacaccagagatggtagggtggagggagctccccgatgtggagctaagccacctgcctcacctaggcagtcttggctcctggaactgagtatcacactgaataaggtgtcagggtggtcactgcccgttccgtattaccagtccctgggtttggggccaacctctgggcgtacaaagctatctgtgttcttgttttccaaccctgatgttgccgtcctcaatttcttaatgacagtcctgggggttgaacctacagtctcgtgcatactaggcaaatactctagccctgagctacctcttgtttcttgaggatttttaacctgggattggggccagtgtttccattttactctggccacaagcaaatggtgcagccagctctgcctgtagcaacctccagcctgaggctattagccttctgttccaggcttgatcacaaaggggtaaacccagctctgttccagagaaccacattcccacccatgaacctcacgcataatggttgaaatgtaaccacctcatttgtagtttcaactgaaactcaaagggaacatcctctttgaggatgaggacataaagaaacccagagtccgtgggcttccactttgggccactgggcttcactcagaacttcttagaaatagagcaccactcctgcctttagacacacatggacagactatgctccctgcctcatggtagcagcccccctgcatggggacaactgtgcatggccacgctcctcttcttcctcccatattagccccacaacccaggagtgttcatgggtgtctgctccagactggctggtttcccccgaggaaccctgttgtttgacccaccaggacacgactggacagaaacctccctctagtctcctccccaactctcccagcccactcaagactaccagggcttctcttgctagcacataagagaccctgatctgtccccagaacctgggacaagccctaccccaggctgctgatgggcttccctacccgtccaggtacgagctgcgggtcatcgtgtggaacacagacgaggtggtcctggaagacgatgatttcttcacgggagagaagtccagtgacatttttgtgagggggtgggtgacagtcacagactgagctgggcatgtccgcttttctgggagaaggggatcctggggtgggaagggaccctcgcggtgtggccacagagctggagcaggtgactcctcccagcaggtggctgaagggccagcaggaggacaaacaggacacagatgtccactatcactccctcacgggggagggcaacttcaactggagatacctcttccccttcgactacctagcggccgaagagaagatcgttatgtccaaaaaggagtctatgttctcctgggatgagacggagtacaagatccctgcgcggctcaccctgcagatctgggacgctgaccacttctcggctgacgacttcctgggtgcagagcagagacaggcctagggcccagagctgaggggcaggggtgggtgggctgagtccatgggaggggtcacctagtcctcagagccagagatagcaaatgggaatcttgcctctccaagaatcttcccagttgcttgttggggtcataacgggaacagccaggtgtagtgggtacaccaggtagtcgaggtaattactgatgggaaaccagcaagaatctctaaggaggcagatttccctgggtctcagattgcaccaaactctatctgcatctgtaagcctgggtttggtaagacttcagtggatgcactatagccaggatgaagatgtctagctaagcgagggcctgagcaaaacaaaagtgggagtggaaaagaaggaagcgggacagtccccacccctgccacgcccacccgagactgactccgatacgatgttgccacaggggctatcgagctggacctgaaccggttcccgaggggcgctaagacagccaagcagtgcaccatggagatggccaccggggaggtggacgtacccctggtttccatctttaaacagaaacgtgtcaaaggctggtggcccctcctggcccgcaatgagaatgatgagtttgagctcacagtgggtaccacttcctgcttgggatccgacccacaggggccaggctgggatacctagccctgtgggtcagacactggaactcttctgttctttccttcagggcaaagtggaggcggagctacacctactcacggcagaggaggcagagaagaaccctgtgggcctggctcgcaatgaacctgatcccctagaaaaacccaagtgagtacccgcctgcctagaccccaattacaccacaccacgggagccgaaaagagaagagggcccagacccttctggtcttcttgcccttacttcagaggcaactactttgttccctcctggcccacagacccatcatgggcttcaacccttcaacccttccttcaaccccgaagctacctcttccctctgaaccaaaagaagctcatcttcaaagaaagctgttgctttcccaggaagcccagcccccaagtctgacagtggtatgggttcttcctagtttttgacaaaggcaatgcaagcactccaaaggtggccagacttggtgccagaaactcctgcttggtggaggtctctcaccaaaccccttcccactctcctgctatttccctgtgcttgtctgctcttcccaatgctccagtcggccggacacaagcttcatctggttcttgaaccctctcaagtctgcccgctacttcctgtggcatacctaccgctggctactcctcaaattcctgctgctcttcctcctgctgctgctcttcgccctgtttctctactctctgcctggctacctggccaagaagatccttggggcctgagccctgcagtcgcctaggcctggtacttcttccttctgcctttggacaagggcgggccagcacatgggacacactcaacagacacacataaagttcatatgtgtacacacagtgcacacgcatgcagaagtgcacacacgcacataagcatacacagaatacaagcacatatgtgcatccacataaacatgtattgcaaactttcgaactttaaatgtagtcatactctcatcagaaccagaaatgactcttttataatttttatattattgggacagagaagtgacatagcttgtccaaggccacctggctaggtggccctgggtctccagcctaggtgccaaagtgccagtctagtgtccaccggctgcagcagtgttattctcggactctactccagttccacaagcaagaggaagctgagacgtgggcggggtggcacagggggcagggtttgtctagggttggcaagctgttctgaaacagttcctccttgtgtaagaggcctccttgagtacagctggctcctacccccagggaaattgttccaccagggaaaacagttaagctgacatcagcctaggaccgtgtccctgcaggctttgagattcaccagcatgttctcagttcactgcttccctaggtccagaaagtaggaattcctgttaaagcatcttacaaacgaagaaactaagactcaagggactctaacctgcccacaatatctggggatagaaactcaggcaacttggacccacatccctcccctgatccccctcttacaatggggttatggcccacatcctctgaaagatgatgggacagttgttgggaaagtatatccagaggctagggagatagctcagtcaaaagtgcttgcaacacaagcctgaggaccccaggtcaagtccctagcactcacaaaaaagctagggcacggttgtacctgagcctgtgaccccagcactgttggaagtaaacattggaggatgtctggggcttcctgggcccagattagctccagatcagtgagagaccctagcttaagtagagttctacagcctctctctgacctcctatgcgtgcacaggtgtgggctctggcatgcacacgcatccaacactttaatttgatattgtgacattttatggggcctgctgatcttgtgacacaaactgcagacagtagaggctgacaaggggaccttaccaaggaactctgcagaaggcagagcaggttagccccttgatggcgggcaagttgtggagagtgaggcacggcgctcaagctgcacaaacgtttgctgaggacattatctgtgggtttatcataaagggagggtttgatggccagggatggggctcagtgggtagaatatttttgcagcattagtgaagccttgggttcaatggcccgggctacatatgccagtggtaatgaggcatgcctagaacccagctctcagccggttagaagcaggcagataagaagtcaaaagccatccttggctacatggtgaataaaagaccagcctaggctaattgagaccatgtcccaaaaaaggaaggaaggaaggaggggagagagggaggaaggaaggaaggaaggaaggaagggagggagggagggagggagggagggagggagggggggagggagggagggggggagggagggggggggagggagggaagttgagcaattctgatttcctgagaatatggggagacagaagcctgcatgatgtacaggcgatctcaggaaggacgtgtgtggcctgtaataccagggtctgcctcaattcatcattgcaagcaatcggggctgagtccctgacaaatctgccacctaggctcagggcagagctggcacagtgaggtctccccgagaagacaggatctagaagctggcaatctgatactagataagggctccaccctggctctagcactcactatggaaagacagaaagatgggagacgtgtgtgggtgtgtgggtgtatgggtggatggtgctggttatctgaccagcccctcctgtcttctccccaccctagccggcctgacacggcattcgtctggttcctgaacccactcaaatctatcaagtacctcatctgcacccggtacaagtggctgatcatcaagatcgtgctggcgctgctggggctgctcatgctggccctcttcctttacagcctcccaggctacatggtcaagaagctcctaggggcctgaagtgtgccccaccccagcccgctccagcatccctccaggggctgctgcgtattttgccttccctcacctggactctctcccaactccctgaggagccctcccacgcctgccagccttgagcaagacacctgcttgctggacttcatccccaccccacacccaaactgttgcttgcctgatcttgtcccaggcctgcctggggtttggggcacagttggcctccaaaaccagataccctcttgtctaaagtaccaggttcctctgcccaaccccaagagtggtagtggcccaaccctccctgtgctttccaaatcttgtcttaaggcaccagtgaaattaaccaagaaacgcggagcaatgcccaaggctctgatgagtaggaacacgtggaaagcaccaggaatgccagcagaggcgaggcggcacacctctctgcagagcatccaggccgagcggcgggcagcggccagctgcttctgcgcatgctctcctcttggctctgcttctttctcacagtcacagtcacttcacagcttagccttgggcttcccatcacttccaggggtgcctctgccttggccagtgtgtgtcagctagtacacaagctccaagtgtgaatcaggtgtactggccgtcctgaagactgactgccctgtccttcctgccgacagccacacccgagtgtacacttaaagcggtgcccttctgcctctgtgggcctgctggctgctgttcctttcttgagtgtgattttttttttctctccctcaataaaataaatcaaactctgagac

SEQ ID NO: 16 - DNA, 136666 bp, Danio rerio
  source 1..136666: mol_type = genomic DNA
gtgcggagcggcggcgcatcacagtagtgtcaaacactctcggatcggatctgacgactgtactacatgtgcgggagaaaatgaaagctctttaatttttaattactcctttttatgatattgcgcacagaggatgcagcttgtacagtgaagatgactcttcccgtttatatatgcagcaaataaaagcagttcggattttataacaagttaagcagcggtggtcatgagaggtctgcgctctttgtgatgaatcatatatttttttagtgttttgactctttttcattgtgagttgagatggctttagtggtgcatctgaagactgtcacggagctccgtgggaagggggaccgaatcgctaaagtcactttcagaggtaaagagcgatactttttttcatttacagtgaacgggtgtgtgctcgactctattgtacgcatctcggcatattcacgaataggtttcattttgttttagcatattttacgcatacgcggtggtggtaacttgagattctgatgaaaagttgtagaaatctgttcatgtaactattctgctacgtatttattcaggaaaaatcgctttagatgaaaaatagatcaaaaatacccatgttaataaatgacaacaatattcacagacataacttgagctgctttctcgtttggtttcattagattttcttttccagtgcatttaatgttcactgttgtagctaatattcaattaatcgttgatttaagctgtacagcatgtaggcctatgtatattcatcccaataggctgtactgggatccccttgcagtataaaatgcattaagttttaagcattgaagagtaaagcagatttgtttgaagtcttattgttaagtcttgtcttatgcacctttctgaacaacatgttagctaaatgtaatgcacgttaggctttacattactttgttttagttatatttgtttttcagcaccttggacagttgcgcagtgttcatctcacagtcattttctttctcataaaatgctctctctctaaaagaatattacagaggtaaatggtgcagaaatgttctaggacaaacaacattacttctaataaaaaaatatgaagcatgtgttaaaagactaaatatcttctagtattgcatttttttcaaacagtatttagagaatggtattatgtaatactctgaaagatgcaaatttagcatgatattctgtgtatgctttcataaactccccagtccagtaatttgattgagacacttcaagggatttaagtaatttgctttgtcatgtttttcctccttttctatgagggcaatgactattagctctctttccaccctttccttccctcctactttgggcttaatctccagcacctcagtgtttggcgatctcggctgtctggagcggaagggctccactgagctgtgtcctgtttctctgtgggttgcataacttagattgagtatctctaactagatcttagtacaataataataataaaaaatcactgttattttccactaaatgttttatcagaaaaaattatggaataaaaattttaaataccgcctaataaataatgcaaataattaacgtccttgtaaaggctacaaattattgaaaatgctgtttgagattttcttgctgctcgaaaggttgctcatcaatttttatcaaaccttcccaagtttatgcatattacataaccagctttcatctctcattttatggttaccagtgaaaaatgttttatgctgtaagcctggtgatacttagcgtttgctcttagtttgttcttaagtgtccaaaactatagtttgcaaaatgtgtttaatcagtacttggctttatgttttgactttgaagtgagaaaaaaaaaatcctctccagctgttttgttatctatcacactgcatgtaaatgttacctttgggagaagcttttgtgagcaacagcactgagcaatgagtttgcaatgagctaaaaacagtgctgactgtattttgcgatcttgatgcataatgcaacttggctatttttactcttctaaaactgtttgacatgacatttagcggggccaggcagtggcacagtaggtagtgctgtcgcctcacagcaagaagttcgctggttcgaacctcgactcagttggcgtttctgtgtgaagtttgcatgttctccctgccatcgcttgggtttcctccgggcgttcctgtttccccaatagtccaaagacatgtggtacaggtgaattgggaaggctaaattgttcgtagtgtatgagtgtgtgtttgtggatgtttcccagagatgggttgcggctggaagggcatccgctgcataaaaacttgctggataagttggtggttcattctgctgtggcgacccaggattaataaagggactaagctgacaagaaaataaatgaattaatgaatgacatttagctgaattgttcaacacagaatgaagtcaacactagacaatggattccattaaattacataaaaaagaagtattttctcagctgtatgtgatgcatttgcatatattataaaaaatggaaagcacttatactgaatatagtaagaaaaagcacttattttaatcaaaaaggctacagctaatgatcatctagatatttacttttcataagaaatgagtttatgtttgcatgcatatgtgtgcgagttggtatgtaaacatatttatattgacccctcttgttagcttgtttacaagcacacattgacgaaagtcaacttgcacttttcaatattatgcaggtttccttaagatacaaaggacaaaaaaataggcattttcatgttttccctgatatttctgaataactgcagtatttacaatatacagttcacatcttcacctatttttaatgtatattgcagttttatggtaatagtagcgtatatatatttatatatatatatatatatatatatatatatatatatatatatatatatatatatatatatatatatatatatatatatatatatattagggatgtaacggtattgtaaataccgtcataccgcaatataaatttttttcgatattaccgaagtcgcatgactcggtaaaactatagtgcttctgagaaaatttgctcaggcgaatgaagcgaatgggaggtagcgaaaactacaattcccatcagcccatgcttgaccatcatcccttgcggtctgttgtcgctacagatccagtaatgcggaaatggagtgtgctgctagaagcggggatgaaaaagagctggaaaactctaaagcgggtgttgtcgccgcgcgcgtactgaatatcggtgttgtcgcgcgagttcttatcagctgtgttgtcgcgcgagttcttatcagctgtgttgtcgcgcgagttcttatcagctgtgttgtcgcgcgcgtactgactagcggtgttgtcagcacactgttcagattgatgcagacatgagacctctatcttactcatggtttgtcctctcaagtgggggaaagacaatgcacaacgttacccactgctgtcaacctgggccaagtcatatctctcttgtcccagaaacctcagtcccaaatgagaggggttttttttctgttgcaatggacattgtaaatgcccagagataccagcttttaccagattatatttatatgataattttcctttaaacccatctctatctaagtgagtgagtgattaaatgttgaatgtgatgagttttcaacaatactaaattgaaactttattttttttacatggtttaatatttttttgttattaaaattgaagttcctgtttcaaagcttacagatagatggctaatttgtatgtcattgacacttttggcagttttttggagtattttcataagttttgttttttcctgtaaatgattcaataaataccgtaccgtgacattcataccgaggtattaccgtaccgtgaaattctgataccgttacatccctaatatatatatatatatatatatatatatatatatatatatatatatatatatatatatatatatatagaaggtctcataacagttacataagatacaaaatgatattctttgtgtgtttatataatactaaaagtaatataaagctagtatgaacatttgaactgagcctccacaataaagatcaacaaaacatcctttattttttgaatttcctgtgaaaatgcactgaagatgcacattatttgtaatttaagactttgttattaaataaacagattctagcatatattagatggacgaaatggcaaaaatctcatttcataatacagtatgtcatctcatatcctgataccatttttgtaaactcagttcaatgtacttgtacatattgtatgtgatcatattttttaatgcatttagaacttcagggcaaaaatttcattttaaaatgtacaaatattaaataaataacaataaaaattgaaaacaccttccaaaaactaatgataatcagtccaacataaaaatataatcacttaataaaatgttgtactttcaagattgcaactttcttacaatgctattattattcatcctttattatcaattcatattattatgttattacttatgtttctgtctgtaaccctgtaatgtcatgtaatattgcactcatatacgttttgaaaatatactactataaacaatgaattttatgacaccactacagtatatattaatgatagagcataatatgaaaagatgacttgcatatacaatatattgtcatattgcacagcattaatggcaggtatgctatactatatgtctagtgaagttttattcaagcatcaaatgaaacagcatactctaaaaggtcttgaaaggcatagactaaaagctcttgagacttaagttattgatattaatttatttaaattactatgtgtatgtttttaaaggagttccacacagtcaggtagtggtcaaaacagatatgatcaatgtacatgtgcaccaaactaaaatatatatacacttttgaattgaattgaattgaatttaatttaatttaattgaattaaacccccaaaactgtctctttcctctctatatatacagatgagaaagaaagtaattccagtgatagttgctgctgtgagattctgctcaaccatattgaccttctaacctttttttctccctgcaggtctctccttcttctctcgggtgttggaaaactgcgaggatgaagctcgatttgagcaggtcagtattttttttctcttcacaatctctccagtttcccctactaactcaagcatgttcaagtgtgacagcaacatcgtagacctacgggcactcaaacgtattatactgtatattcacttcaaatttggtttctctccccaagagaggaagtgatgaaggaatcacacaaagaatcaaaccactcgaccgtggccagacgcatcacatttagccccgctgattcctattaatgctatttgcacagaccctcgggcaagcaatacagcagtatatgtaataagcttgtggatagcttaaattaccattagcataatacagttctttgaatgattgctctctttacttgaaaagatacctactggttcagctgtcagcattgtatttatgtaaatagccttcttattcttaaagggacagttcactaaaaaaaacaaatatttgctgttaatatatgggccatccaagatgaaggtgttagtgaagaagattcttagctgaaaatgtggtccgtggtgattcataaaaaacctcaaatgaataccttgggagtcatgcagataatttaatttgacattgggacacacattttcaggtacaaggtacaattcttgttattattaaatcattaactgtaatttagctcagtaaactcctaattttctgctgattaatacagtaatacagttaattacagtagttattaaggtagtagttgggtttctgcattggataggattagagattagaacaagatcatgctgaatatttactttataagcaaggttggggaaagatacttttgaaagtaatgcaatacaatattgagttactcccccaaaaagtaactagtcatgttacttagttactttatatagtacagtaagtgttgcgttacgttactttagcgtttttatttcctggcttaggcttgatttctttctgaactttttttttttttttttttttaaatagaggagctctgcaattaacaacacactgtaaaatctacatctacatttacctttaggaaacgtttaaaaaattgatatttttggataatattatctgagaatgtcctgacccctatatatgctatacatgccatatatacatattattgaaagtttaaatgctccttttgtactatttgtcttaagtaaaatcactgtctattgagacaatgcccttttctttgatacggtcaaaataataaacacattctctcatcgactgtgtgagtcattgtgactaatcttaattcagcaattaattttttaaaagctgattaatttaaataaaaaagtaacttgccttacattttcaaaaaagtaactccaatattattacccattttttttaaagtaatgggttactttacatattacttaaaaagtaattgcattacccccaatcctgtttataattactaataaacagacaatatcttaaaaaaggcaggcattaaaccactgataatagtcagaattggtccctaaatgaaagtgttaatgatattaaaatgaacatgagtgattctatggctacattgtgtgattatgattacaaattttggaaaatttttattttgcaaccagagagtgatttcaaactggaaatagcatgatctctacctccatagggaaagattaaggcagatgctgtttaaaacatttcagataatttatatggctgtatacacagccatacgtgtctaaaggtgaatatttaatcaagctctaaacatattttgagaaagatcattccagagttttagactttgccctcttaagtactgagagttttaaattttctcaccttacagaacgtgatagacttgcttgaaactaacaaggctgtgctgaaaaattggaactaatcaatcggggtcctcgactagattttatctccgattttttgggaggtgaaaatctggtataattgaggttaaaactcctgtagtcttagcctgaaataaaatgcaaaagagttcaacttttagagctctgcactgttttaagtagcacttttttgtcatttaaatgacagaactataaaaatcatagtgcatagcatataaaattgaagtgatgtgaatattttcttgacctgaacttagggaaatgcaagacaaccatataaaagagaattgcaatcatccaggcttcatgtcataaagcagaaactgatgtttacaaggcagtttctgtaaatttttgtaataattttgtgaagtcttcaaaagaaaagttgctgtctaatacagtataacacccaagtatttgactgtacaggatgacataactgtatatcaatctattaccaaattgttttgtttctgtgatttgcacgagtttgtatctctgtcttgtttgaattacaaataagacacctataaatctacctatagaatctcttcatgtgtgcacattctaagcagaaattcaattacattttgctctctgtcttgattgagactcccacattattgttagcctcttctcacctttgtaaggttgtttttttcagtgctgaaaacaaaaagcattacaaaatttctgtctggctccaattgtaaacttttaggttaaaaggaaggatgtattttcactgtatacacagtcagggaaggagaatgagcgactcgtagtgaataagagaataaacaaaaaaaattacttaaaaattagcattgtctaaatgtaggaccatacagttgacacagttttgatgctaagcagtggcaatttttaatctttctgtctttgtttgccttgtgacctttccgggtgacctccagcctcttcatttgctctcaatccttcacttatagttttatggcgatagtttaatcattactaggtggttagagaaggtcagtgcacacttcaaattcactgagcccactcgccacttgtgattacatcacagacagttcacatttaatcattgtgctgtactactgtatttctctgtctctccttacatatctaatatcaatatatctgcatttggtgttgagtaaatgactaaataatggctgaatttatttttgttttttttaaattttacatttgtttgtttttggcaccggcattagatttttttcattaggtttgccaggcaggaaagatcaggtgtcatattcactagaagcaatgtgatatttagtgtacatatcactgacgttcatcgaaagcagagcataaactgaaagtaaacagacttttatttaaaaggaatgtttgtttaaattttctattgatcgtgacagcttttatttatcatttgaagttcagtgatgatcaaagagtgctatagctgtgcatatattttaaaaaatcaagaggaaaatcacattgaattgcattgtaaaaagcttaaatgagctctgcgtgtcagattggggttttctgcatctacactacatggagctgtaaatttgtgctgcaaacattgtttttagtttagactttgcaagtttatatttatgatgtccgtgttgtacattcattcccatgccacagattgttctcatgctgcatccaaagtcccatattgtttgactgatcatatgacatttttattttgttttttttgcatgctctgaaacgaggcatatttttatccagttttacacaataataaaaattgtcatgcttttcaattgtcaaagcttgtttggtatgctgtcccgggagaaagccctgagcttatgagatcctcgagccctgggctccctcttgtttgcagagcggagtttgagctcagataaatcttgatgaactcccccaacttatttctggctaatgacagataggatggttaacggaaaacccacatgagcatggggagaacgagcaaactccgaaccgaaatgtcaactggtttaagaaggattttaaccagagactagggctgtgcaattaatcggaaatctggcttcgatttcgatttttggcttctaacgattttgaaaaaccattaatcgagataaacgattattccagtatataccgccccttttccagttgtactcatttattgctctgcaaagctcagttccacgtaaaaatgactaaaagcatgtactgtaatgtaacttttgcagcacgggttgcgcatccgtcatatttttaaaatcgccaaagagcccatgccgtgtgagtgtaatctaacgccatcttaatgtgagcgctttaatggtaaaatgcacatttgtgtcagagcgcggtgtttagtgattatccatattaaccctcatttgtgtaataaacaaacaagttgagaatcaaaagccacgtgaaagagaaaccatatcagagtcgcactattcttaaagagacagcgcgcaatatccctgctgctgtctgtttttattattaatcaaacaacaaaaggagaaaatcactcactgctcttgactgaaggacttttctagctgaagtttttcttacagtgaagatgcttaaaacacagtttaaacattacagatttaataacttatttcgtttatctttgctatgatgacagtgcattatattttactagatatttttcaagacactactatttagcttaaagttacattcaaaagcttaattagtgtaattaggcaagacattgtataacagtagtttcttctgcagacaatcaaaaatatatattgcttaaggggggtaacaatattgagctattaaaataggtttcaaaatgtttaaacctgcttttaataagccttaattagtggttggtagagtgaggggggattcttcaagatgaagatactgagataagaaaatctggttatttatagcgagttaggaatcatctctttggtgaatcaatcaggagcagatgtgggaccagctgtgaacataaacatgtaatactctcgacattagctaataaataaacttaatttgaagagagataagtttatataatccagtttttattgacaaataagcaatgctcataaaagtattgtggaaaaaagttgagttgttgcttggtccagtgggcatttgcacttgcgtggaacttcaaggacaaaaatacactggtttctttaataatttgttcaaatgtcattctcatcctgtaaatctttacttcagctgttttggatttcattttagttgtttggttgaagtgtaaacatcaaatgcacatctaattaatgtgattttaaaagtatttcattgaaacaggcattagtccatatcaccgtttaaatctgtttattattatatatccttttgatttattaataaactatttatcatattctgctttattgagtagattacacaattctgtccaatctatttaacatctcatagcccaaccttacctttcttatccagggtgcgcagctgaatacacctttcaggtctctctccagctgtattcattgtactctctcaaacagactattcatttgaatcagaataaaccctgctattgtttatgcatgagcagttattattttatcttcaacaagctcacagacgctggctaagacaaagcacatacataatttaaccggatgtgtccttctgtttacatacctgatgtagtgactcattttttccccacacaaatctgtgcttcctcattttatgtaatataaaacaaacaacatttaaactctacttagcgctgtgcattgttatggtttatttttgcagtgctcttgctcactgttttaggtgcgcaacctgatgttgactgtgatggacagacgaggttcaaagtagacgcttgctgcaaaattgcccacttttacatcagctctgcaggagtgcctgtctctaaaccattgattttatctgcaggagtccagctagaaacttgttgttaacggctgctgatgtgaatgttttgcgctcgcgttggttaaagcactttttgtagcggatgaaagcctcagtggactgactgtcttgttctgatgtgtacagatttcctttctgttgcttgtatttcaccattataatggcaaatctaaaagaaaaggagactgattgatggagaaagagtttgctgaatgctttgtggcaggcaatttcgtggcaattaaatgatgtctcaaacagttattttcaaccagggatacgtaaaccccgatgcagttttttaaagcagtttgtgttgtttttatttactgtagtgcaacttaaatcatctttacatgtaagtcaaagctttgcactatgtgaagtttaattataaactaatttcgcgaggatcacagcttatgattgacaaggctggccccgagtcaagctaatgtacgaaacaccaatcagacgattcctaactcactataaataaccaggcatcttactattagtcatcttcgtcttgaagaatccccccttctaccccctctcatcgtctttttcctctatagggcagcacggcgtcccagtggcccagttcttgagatctacctgagctcaaacgcccctctcgccctgcaaacgggagggagccccgggctcgaggatctcatgagctcagggctctctcccgggacagcatgccaaactagcttattaccaatcatcagctaagtgtgaacttttgaagatctttgcagatgccagtgtatttcctatttgctgagcttctccgctatttatattctaccacataagggacttatatttgacttattaaactttccatctggggttttatttattaatagatttaatgatacgtttaggtctttcaaagagaatgtttctctatgaaactggtggttttaggaaggcgcaggaggctgcatcatgagttgttttcttgcaccccaaatagggatgctcataataaccgattaaccgttaactgaaaaggcccattttaactgattaatggtattagttaaattatataaaaaaatattattatatatatttttaaagtttggctgcatcaggggccaaccacgacgaacacgctttttgcgttgagagaggcatctttttaatggttgactaacggccgtgagcattttgcattctttttcattcttcaatcaaatgaaagcagagctggggtttctatttattaaatccatattttctgtgaagtggttgatatgaggtagcctgctatttttatttgatgaaagaaaaaaaggcatatgattggacaaacagcatatacctgttcttaaaaagcattcagtccatgtttttgtctgaattttgacgttttgtcttgatgaaaaatatctagggcaggactatttattttattctttttatttagtttattctgtttttctaatattgcaggtgcttgaagatgtgctgttgttctgatgtactgtatgctgttgttcacatgttaaaataaatcagttttttaaaatgctatatttattgtgtcagacacaaagtagacatgtcaattgtttattttattaaataataatttaatattaatctgaccagtcaaccgttaaaattaaaacgagaggcggttgtctgttggcaaaattaacctgaaagagcatccctaatcccaaattgaaacttccctcaaatattctcacctttaggttgttccaaacacaaataatttttgttaaactctgcaataaaattaaagacatttttgtaaaatcttagagatatttcattcttggaaagcagattaagctaaagcaatttagtcaaacctgtaaattgtgttttatcaaatgaattcaacaatgcacatttctgttattgtacaactaacatatactgatgactactataataacactggtggtaaaatgaataaaatgaacacttgaatattgtgagaattataacagatagatcaaaatgtgtaactggtaatcaaactgtcaagaaataagtattatcaattatttaaaccaaatatgtgaagtatcacacatccaattatggcaatgttaacagttttgactgcaaattaactgctttatttacattcactttttattaaaacagtacatttaagtgtattttagtttaaaatgacatgcaaactagatgtttttttttttatatataattttgggtaaaaagaccttcagtggagggacagaaatcaaataagatttgaataaaaaaaaaaaaatcttcatttgtgttctgaagataaattaaatgctatgagtttaaaacagtattgcggtaagtaaataacgacaattcttttttatcgattttgaagtgaactaaccttttatgataggattaaatgtattcattatttggctactgtatgtttacatgcaatcaaactgactgagcttaatctgaaaaatgttttagttgaatttgaagaagaggtgtagacctgaagtaatccaatcaacagggattcaaaaatacttttgccatgtgcacattgcacaattatgtgtgttgttgtgcctgtgttatgaagtgcagaaggtttgttctgaacatctacagtatatattgcacataccaacatatacttgaattagattaaaatgtttaggatatatatcagatctgcaatcagattaaatttcctcgatttatgaaaataggtgcccgtaagcatagccttttgtataaagcaggggtgtccacactctgtcctggagggccggtatcctgcaaagtttagttcaaaccacaatctgacacaccggggctagctaatcaagctcctactaagctttttagaaacatccttgcaggtgtgttgtggcaagttggagcttaaatcttcaggacaccagccctccaggaccgagtttggatacccctggtataaaggattatatttttctagttttgttttgaagaatataaaggtggagaaatgttctaaaatatgggcctggtaatatgcaaacattgctcattgctcattttctgtgaatgcttatgagtgaaaactgaaatgtatgtcttgcactacacaaatagatcacacataacctataacaaagcaataaaaatgtttaaataatgaatgcttgtcccctaatactttttcatataaaactgtgtattcaagagatcataaagtggctgctgtatcaccacatctgctgtttgcatgaatgcaatacacttactgtatgcatagactataaaatacagtttccaccctttcctattactccttcgtgcatttaacagcataatcatactggagcatagttatttctgggacatgcacacttctcctataagcctccttcatatccattacaaaacctcagctctgtcttttcacattgcatcagcgtctcagacacgaaataggagtcgctttctcattatactgatgggggtttgtctcatcatgaccagcagatctcatttgataagatcattctcttcaatggcccaatgaagcaccaaattgcagcaatctctgtctatagtcagtctaatcttttttttttctttttttttttttggttatctgttcagcttttcagccattttaaagcacatgcttcatgctgccaagaataaatgtttaaatttcacattagatgctgttttgatactagaatggattgtgaacaaatattgcacagatataatgaaacagccaagaaacacacaaatgcagttgccagagtttaaaaaaaagatctgtcaattaacagtttgatgacaatgtaataacagacattgtcagtagctcatgatgtatgggtggctttatacagtatatgtacacttttaaattgcattaaattcaattttgaaaatttaaatctgcaaaagtgacatttatgatacatatatattgtaatgtctcgacagggtacaaacaattttaaaagtgctttttctgtatagcatattatttttaaagaaagggagttcagtccacccctcatgtttaaaagaattaattcattcactcgttttccttcagcttagtccctttattcatctccacaggccgccacagaggaatgaaccgacaacttatcctgcatttgttttacacagcggatgcctttccagctgcaacgcagtactgggaaacagccatacacactcattcacactcatacactatggccaatttagtttattcagttcacccatatctggaggaaacccacgggaacatggggagaacatgcaaactccacacagaattgccaactgactcagctgagactcgaaccagcgacctttttgctgtgaggtgacagtgctaaccactgagcccccatgtcacccaaagaatggattctccaccagaaactcccatcctgataatggcagttattttggggaaaaaaagtattaaaaagtatatagagcagcttctagaaggtactttggggtcaagcacaaagcaaagtctatgttaatagggcaaatcatcagcattcattggtggggcttatgatgatttttcaaattttacttttcatgtagtgtttaatgcaaaagatgtaatgtaatgtaagatttgggtgcatttttagtgattgtttacacaaactgtgtacaaacattagagttcaaagagcttttaacctcctagggcttgagtgtccaaatacatggacagcactttttagctcttaagtggccatcctcttaaggcccaaggtggttgttttttacatgcattgcttatttctctttgctatttgggcttattggaacttatttacaatgaaaatctaagtatcatcctttgatatgatgtactttttgagaaaattatgtccatatgtgtggtacgaatttacataaaacactgtttcctgaatgtttttaatgcatatttaacatagatttttttttacttgctttgactatcagagagtaaaactattttttttccctatttttggcagttatagggttaggcacacatgctgcaaaacagttgcaggatgactgtatgtctgtaacaaaacataaaacattcaaagtattttaaatagaagttactttgcatgataagacccctttgtataatgttcacttctttacagcaagcctcttgctgacaaagtggtttgaaaagatggtgcaaaaagtataacgatttaatatgacaattaatttgagttaaatgtaatatgcctgaagaatgaatagactgtaaatgacaatgaatttgtgtttcttgatgtataatcccagaggtttccaaatacctttcaaaattttagttttatgttcagcagactaattgtggtttgcacagaaaagtttttttgttgttttgatgatgattgaagttaaatgcacattactgtacctatccatgtcaaaatatttaccagaaccacccagcgtgaagttttgtttgtttagaggcactttcaattaaatacggggacaagggaaatgtgaacactcttcttctccagttttaaaagttaataaatctattaatttatctgtgctagccatacataattatttgtttagttgaattttaattggttatttgcaattagcattgctctctccgctaaatttgtgacatcaattgagaacacatggaatcagtttacagacaattaaaataacacgtttggttacttgtttcaaaatagattccaaaacaggctagcattttacatttaaccaacttgtacaatctaaatatttgtaaactgctgtgctttcctacttccccctgccattaacatttgtaaaagatgtcaccctttcttttgaccatttagactaaatggcaaagaaaacggaagattgtatgaggctgtgttaggacttagaagtgaacgaggtcacctagaaaagtgtgagatgtttgaggtgctgcaggagaaagcacacactgtgagaccatatggtctagaaagagaagagcacagaagtaatggccacattaaatcaccccagattgctgcagtaaatcaaaacgagctgttttatttaagcttaattagctgaaaagctctggaagattggcgtcacactggtatccttcaactttatgctttaacgtgttgtattaatgatggaaagtgtcttaatgtggcagtatatgaggcattgctgaggatggaatgtactgtaggcatgaagctaattaagaacaaggagctcaaagaagaagaaacaagaagtgaaaagactaaaaggtgcaggattttcgaaagagacagacaaacaagtaggagagaaaaggagagaggaaaatagcagagcaagtgagcatgagagaaaaaacaccaggaggcttgactgaacaggctgattagcgatgcggtttgatgtcaggaccagtgcacattttgtacctaatagcgagccattgattttcatttcaagagttgagcgttcatgcatctttccattatctgaatcatagacgaaaagaagtgagggggagggagacattgtgtgtcagagcgtgtgatcctttaccattgaataattcactttgcatgcatttcaaaactgaggaggcttttagtttcttagagctgaattgcaagctcaaatcacctcacgccttcaccaacactggtggagagagcttgtctattcacagcttatgtaaaagagagacagtagagccactggtgaggtaaattaaaaaaagtaaaatataattgaggttgatgatgaaacaaggtgcaaatttgtacgtgaacgtcattgtgtttttagattaacgtgggagttatttcagcccaggctcatttatttgaaatacatgcctcagactacatattctttgcaaaatatcaaatacgttgctatcggcatgttttagatgacaaattcattagaggtcgatgtttcgatttttgttaatataaaatagttacttttagggatacatttttgctttgtatttttcagatacagataatttaggcaggatctttcgtccagatcacatagtgaaagcctgtttccactgagtggtacagtatgctacagtacagttcggtacgagtctcctttatcaggcttgttcctctgccaaagggtaccaatgatacctttttggtgggtgtggtgtatgacagaatgtttcagtcgacgtctttcttgcttgaagttaacacatatcgattacacatataagaagcaaatgctttctatacataaatacttatgtataaataaatgtttattaaaaacctttctatgattagaatttgattttatctgcagatcaatgataatatgaaatatccaactgtaatgtctgtgattatataaaataaaataaataaataaaacatttatgaacacaaacagagactaacagtctctataatgttaccaattacaaataaaaaactcccaaaacatacattaaggccttttttttgggttcataaatgatacgaaacatttccattcagtacaaacatcagtacaaacatatcatctttattcttcacctttagcgttagcatcttgttaaaagtaattccatcatttcgagttcataatagtccaaaaggcgaagataataacagtttagataatggcagtttgttcatgttttaggttgctgaaagaatcatttgcttcttttttttcgggcttctcctctgattttcatgcttcactctcacgtttgttcgtttctgaaaggatcagatgtcagaagcacttaaacaatcacgcgcacgttattatcatcagctcaagaagttcgatatatcaaatatagacaacggcgagcgattgcaagccctctagagaaagtgaaactgcttgtgacaatattctgtaaacctatagcgttgagctgcatgtctggctctgccttttggtaccctttcgttgttctaggtcccctttggaaagggcacccaaaaagtggtacggtatggtttactttttggtaccttttgacagtaaaaaagggccataaaagcgtaccgacacgtaccgtaccatataccaccaggctattactacagaccctccagtaaactcaaccaatagtgtttttaagtgcactgctaccatatagtttcaatttcattttacattgctttcatctattttttggaaccgtgctttataaaggtgagacaaatatgttcaattacaaatcttagacataatttagtttgtggtaattatgtggcgttgtgcaaagaactgcacaaaaacaatcctttattcattgataatatgtccctgtaaatatcattagtgtgaaaaattaaaaaaggaaagttgttggcaatttactgcaccgtagcattcattttacctagatgtttttgcgatttaccaaaattgtaagccaaagcatgaagcatcatttgccatgagcccgtgttgctttgtttagagctcatagggtctttgcaatggtgtgttttgacagtcattttaattaaagtggtttaatttgaagctgtctacaataaacttgtcaaagtgaccatagcaaattgatttccccttcacgtcagaagtagtgtgagggctttgagtacatcagaaatagaatggtacttcagtttactgtcaggaagttgttatttggcatcacttcatgctggactgcatctgatgtacagaatcactgaaaacactgggctttgtgatctctgtagcctttaactgttgctccacttgcgtccagcattcaacatcacatttggaagcgtggaagcgtcaatgaactttatttcaatatgtttcagttcacttcagtaaggcaatcttaatattattagatgttttgtgaatagactcctggttggttgacatcactaatcaatagtgtgatacttgctaatactatttttaatccattgcaaacactgctactgttatttaggcataacaaactctaactttttttgggaactcaatattattactaatttcagtattttctgttgtagtgaaaacgccagtcaaaaaacatgtcaatcagtgttactgttgcattcaatgtacattcagtggacttcgtacattcaatggtctttttgtatggtctacattcagtggacagttttttttttataataagcataatattgcgcaagtcaaattctaaaatagtctccatcgaatcctaaatttgtttttatttatgaatttaataactaatttaagagtaatttaattggtagctaacgatacatgattctctccacaatggtcctctccagaaaggtaacatttacctttggaaaaaatgctttctctgccctgtttctttgcattatttcagtttgtgctgtagtgtatcccagaggaaaggaaatagagcaggacagagggaggaatgagaatggactctggtttttccagttatcttcagtgaaatagagtccagtcaaacaagacactgagtgaatctgtaatgctgcagtttctgagctcaaacctcatgacaccaggattgagagtctttttaataaacacagatttaatccacaacctatcctcagaatcaaaatatgaatgtgttaatgagtctgtttgtaataatattgaattataataatagtatgcatttaattgtaatgatatagatcatgtacaatagtgatgtatgagaaaagtaatatcaatctagctcctttacaatatatagatacagatttattccatcaacaggtcctcagaatctaaatatttctttaaaattgtatgcactaacctttattaagactttatggaaatgaacatattgtaaattaagtttggcttcccgtcttaaccatgcgtctaacaaacatgcggtaaatcttatgcttacaaaatgtgttatgctatttttgtccaattaatttgtgtttcctggcttaattagtcatgctgaggaactgtgagctagcggttgagatgaatgcagccttctcacaaaaatatcttttcaaagatttttttccctctcagtttaatcaggaaccggatcaagataatccagaaaaatcccttattctttttacatctgtgagcaaattcactttaatgtcttttatcttaacagccagcaatatttgtaagggtattactaattattgcaaagttcactgcaacttgatgcagatttttgtaataacattctctatagttatttgtggcaatcacttgttttcatttgcaaaaaatagtttgactgatcatttttaggtaatcacagtaggttaaaattattgttatggctgaataatggcagatgtttatgctcttttctctaaatagaataatgaaaacaaacacacacacacacacacacacacacacacacacacacacacacacacacacacacacacacacacacacacacacacacacagcacacacataaaacccctaagttaatcagttcaaatgttacactgaatttaggcttcagagtggatcatcgtactgatcatcatacaggacagcagaaatatgagttctaccaaaaagaccagaaagataaatataatattaaattgcatttatttgataagtattatgtgacaaaagtataattaaagtaaatataacataggatttctttggcggaggccccgttcatagcttgaatcggaacctttttgatccagcaatgactgccgaggatgagggcggagacagagcctacccccctggacaaggccaacctggcgggggtggggagaatagtgggggaacgtctgtgtcagtatctgcaaccaaatgaatggacaacttatatattccttgtgcctagtagctattggttggaactgattgtgatgagcgatgtgacattagggaccctatcatacacccagcgcagtgtggtgcaaggcgcgacgcaatggttgtttgctcgtttcagccttgcgcaagagttgttttgacgttttgcgccacgctgtttaaatagcaaatgcatttgcgctcatatgtgcgcccttaggagttctggtctaaaaatggaggtgtgttgaggtgtgttgctggtgcattgaacaaaccagaccagaaataaaaaaatagaccagaacatgtcgttaattcgacatctcatcaattagaaattatcagacaggaggttttgaatatcagacaatagactttattctccataataaagccgagaaagagcagagcagacctcatagcattctcctcctgctccttctaaactttctgtgtgttttcaaaatctttatacatgtttttatgacacacccctttgtgtctctttttaactcttgaccatttttgaataggttttctagtctaaggggtcctgctattcttggctctcagcccactagctcatgtcaacagagatgttacaggtctatgtcagcaaagtatagatgcaacttatgcaaaggaactaagtgtttacatacattgttatgataggataataacttgataatatgttactcattccaacttctgacacatatagcttcatatatatataatcagtgctttacatattcagttattctacacaatcagtcactcagccttctcctagtgttgcttctgtgcaggcatactcatcttacacagtatttttaacacacgctggcatgtttgctgcaaacactacatacattttgtgaagagaaaattaactgctttacacttagaaaatactactcactgagagaataaaatcttcttcaaacaaagcctgtctattgtccagcgcagagcacattagttgtgcacctcacttacacactgcttaatgcacacaagatgtagagcaatacgcaaatatctttacatatgaaaaagaataaaaatataaaggatagataaaggacatacaaaatattctgtgattcctattcatttatagatcacaaaaaaagaagtttcaagcatttgtagattagaattcgtttaataaaaacataacactttgccagtgtccttcaaaccaggctaaactcatcttttatcagtacgacatatttaataatttttaaaatataataaaattgtgtataatcacttctgtttttacatattcgaatacatactcaggccagaatgagttcatttttacataaatctctgttactctgaatgacaatggaacacctatatttggacaatttatctcataaaatgttatttaaaacctgaaagcagatgctgtgatatatttaccacatttctgatctgtaaccctagatcgatggatgaataaatttgagtttccatatcacaaattgcttttgattctttgttttaagaaggtgtaataaggattgattagaaagctgtcttttatgacctttttaatcctcagggggcataaagcagggaaaaaagaagatctctgctcttcatcttcataattattgctctcttaaaactgcctctcaccttaagtttctaataaacgtactaaaggccataggggagattgtagaggcaagtgagtttaaaaaagctctttaatgagcagcttcatctcctcctgtttattcttcctcatattatgcatcgtctattgaagtgaatatggtttctgctctggtgctgagggatttgaggggaaaaatcctcactgtgcttgcctggactttaccccgagggtattcggctgagaccatgcagcaaagcaaagcagacaattcctgcagctctccatcagcggcttctctctgtaggtttagcctatagacctgttcagcagctgctcaagtgcgatggagatttgaaatgtctcacacacatcctcccttcagtctttcatgtttgacatgacatcacagtttccatgcaggctgaatgacttcgagactctgctgtgttttcatttcttcccttctgtgttataaaatgttgagttgcagtcctctgcatctggtaaatatctctgcctctctagtgcggatcatgtctctcatcgcattaactgctcatactgtgatgagaacccataacgtttagatagacaaatgatcctaatgagttcagaattaaagactgtgggtgtccatgtgttgacagacatttgcttgtgtgttggtgtgtggttaataacagcatcccatcaccagtaaacctcaacaaatatttttctttcattaagtttgacttaaggtacttcccggcgtaagattcatttttgttgtgcactgacaaaaggctgttttaaactctctctctctttttaaatatgatgtatgcgtatattgttagtctattaactggtggaaagtgatgcaagaggtgctagggatagttcactcaaaaactggaaatgttctgttacagtaatttactcgccctcacatcatgcaagatgtagtgacttgatttcttcagattagaagaacatgagggttcttttatatgaaaccttgctgatgcataaaatgcaaggtcttatgaagctagagaatcagtctgtgcaagaaattatacattacactccttttaataatttggcaactgaaatctcttacacatgtacatgatctaaggtaaagtgactatttcttttttcctccgacatgtcctccttttggtacttgcatccatttctaaatgttctatatccagcatttaaatgtatgtgtttttgcatactttataccttacacaatgtgtctgtgaagtttcagcccaaaacacccatcagattatttattatacctttcagaatattggatttttctgctctaaacacaatgtagctaattttgtggcctgtgcctttaaaagtggcacccccagaacattttctcagggatggccagaaataattcagcaagtacatgtgcaaaccaaataaaaatcaataataagtttaaaaacacttttcatataactttttagttatttttcacatacttttattgtacagcatacagtatatgctatgtctaaaactaatgaaaattattgagttaataaaacaaacaattgaacaaactgaacaaaaggcatttctaaatacacacacccaccatacagaccctaataatatcatttatccatattcctttttgagccacaatattattaatgcagctttttctactgatgtaccttaaggtaagtattaaattgccattgctgtcttttgatggtgtgtgcgtgctttcaacgacgatcgggtagggcagttgctccctgggtgaaccaagccatacacccccaccccccttaaattgttagctttgttattcaataaatataacaatttatttatatttattctaaataagtacaattattattaatattattatacaattattattctaaataaataacagaagtcattccttaatgttactggaatacaatgtatcaagtagaggggtatgttaagatcacttaagaaaccttttgcatgaatattaattatgataattctaaagaattgaaatacttagacccgacttttggctaagaattaatgaagtcttagctccatgacactttatccctcctttttgctttatagccatgcttagtgaaagttacatcatcatcatattatataaactttagttgtgtggacttgaaaaactcgctgtgtgccgacacttctgcagaaaaggctgttactccggtttcacgccatttgagcggcacgtattttatcagcgcgcatgcaaacaaccagtttgctttcaccaccgttgtttcggttgcacatagagaactcgtgcaaaagatgccaaatgtaaacacccttaaagtctttattctgggattgccactcgtaaatcatattccaatgcttttactagggtattttttatttatttattttttaccgtctctgcgggctgcccaaagcaagatgccaccctgggcaatcatccatattgcccatgcctaaatccgccactgggggagggtaggggcagtgaatcaggtatgtcagtggcaccaacaataattaagtggctgcattttatttatttatttattgaaatattgggaatttacataagtacaataaaattaataacatcaacagaaaagtcatactttggtggcctaaggtgtggtgagagtttacccacgggtgaccgtggtcttcaatgctagttctccctgcccaccattcccgagtgactgtcatagtgtgcctcaatctccaccttggctgtgtcagataaacagcacagtgacagacatgaagcaggtctcacgtaatgtttgtgagaaaatactacagtaagaatgaagagttttattgtatttatttagagttaattcaggccttttgcaatgagtcacacacaatatcagtacaaagttcacacacacatgttaatacgtggctgttaatcaactcggtgagcggggaaaaacgtcatgttgtggtgggtctcaaaatgggagggatttggatcctattttaacatcatgaaataaaaaaagagacttattgtctttatatcactccaatatgactgtggacacactatacagacagttctgtccaaacagcttacaaaagatgattttcatcataggtgccctttaattatatataaaatgtataggttgtggattaatttggaggatgctcatgacaatatttgccatgccttgttgtgccgccatcattggtcggtcatgtacacatttctaaaagaaattctaatatattttatgttggcataacccttattcatatttctgtgatataatgcgaaaaaattgcaattatttttgctggtgtgacttaatataggaagtttgattacactcaaaaaaatgtaatgaaaaaaagtcaagataacaattatttttatgttgctttaacttattttaatcagctaatcaggtttcaacttttttgtaaattatacaacattttacttaaggtgactagaaagtaatttgattcaacctaaaatattagggcagcaagatttttctagtgtagataaaaatccttaaatcttcttcaactttttcaactaaaaccagttcatgttacctaacaaaccttttttttttgcagtacagtgataattctagcacattttgtcctgcggattcacattatacacacttttttataacctttagtcactttatactgctgccaatcaagtcaagatgttctgcttttgctcattacatgtagcaaaatgtgggtcaagacttttccgtgtaatttgttttccccttacttggagaagagtacctctctgatacactttaaatagcataattaacaactgtgttcagttcagttttgttagcacctttgcgaaaatctaatttgtcggtcgaatgtggctgtcactcttgcaaataaccaaactctgtgtgttgaaaacgagattaagcagaagtgacagtcgtatctacctacatgagttctcggtgactttctttaaccacatgacaacaaatctcattccgctagtcggagcacccaagccggtctctgattgatttggcaagaaaacactgtggccctgcagtctagcagtggagtgctgctgttctccataatcgcagtgagacagaacgcctcagcaggcctcagggcagcccgtttgtctgtatggatcagtgtgccagatgggagtcagtgttctaggatcaggagaagctaatgcatcatcccactgttaagagcctgaaagactcctacagtgtcatagattactgctgttagcttaaatgggaatgcaagtaggccgtccttcagtatgccacatactgtaatatttatgcagtcccttttaaagcttgagatgttgatggcaattgaatggacagattagtgcactaaagtttgagactagattttgtccgttggtcgtaattgagaaagcaggtacatttaaagctgtcattaaatggagtttcagatttttatctgaggtttttttgcaccaaaaatgttattatatatatttttaaaaacagttgtttaaaggtttgcaatgacaaaacagtggtataggtgtctcatgtcacctatgattattgtccatcagctagctgttcaagtcttttgtgaaaggtaaattcacataatatacatccatcaaaaacgtcaatatacattctccaaaaactcccgaagaggaatccagatatgtcataagtctgtttttttttttttttttaagggtaagaaaatggcaatctgattcattgacaaaggaatgttaggaaaggaccacaacaaaagtatacattttcttgtttaataagtataagggtgtaacacagattctagtccatgactaagatgtagaccaattttacaatgaaaacaaaatatagaactggaaatagggccaaaggtttaccaataatcttctgaactagtttgtagatttctttccagtttttcttaatcatgtcacagtaccagaatacgtgcatcacagtaccaacattggatttgcagttaaaacaactttgcaaaacattaggaaatatcttatttagacaaactggtgttaaagaaattctgtaaaatcaattaaaattttgctcgtgctttgatattgtggcacctttgaaaaatatgccagaacagactaaaatccattcttcatcacaattttttttccccacaatctttctcccatgtacctttcaaggagataaacaaaattttttataaaagtagcacttaaactaaaatttgatcatggttaacctcttttaataattcaaaatagacagtaagcaatcatattgtttttgaggaatgttttgtaactgttatattgtatagtattgtaaatattttatgatagccattgatttcatactataatttttctagtcaatagctactgttaacataccaacatagtaaaggtaagtaaatgatgacagaaagcacagttgttagtggttgttagtggttgtcaaaaacaacaccttaattactgtaataatttgtaattatttcctgctgttaataaattacttgatatatcagcattcattgcattgctgataatcgattcagctacagaccttattgtgttttagtttaagattaattgaaagtcttataataagagattttggctgtaaatggacccaatacagagtttataattagctttgaaagatctactaactgtcagattgagcgtattgatttttgtcctggtttgttttgttttccaggcgttccgatggccaattgggagtcaagtggatggcgacgagatgctggagatccaagtgtttaattacagcaaagtcttcactaataggtaggacaactcaatacatttgctgtgaccttaaaaaaagatttcagcctgttaatggactggcttctaatcgtgtaatatttattgacatacttcgatactgcaatgtaatcaatatacaattattacagacttaagaaacatatatagtgaaacacgaccatacagtaagtgcaagtacacttccataagtttacgtgctcaacattcaacctgttttatccaaagcaacaacaatgactattccaatattttgcaatgcagagttcacactgtatgactttagctctgattttcacttgcagacaggttttgtgaaatatacgcacaagcgacaaccacagagtgtaaatattctaagatgtgatctgagagaattgttaatgtgtcaaaagcttgttgtgtgaaaaaagaattctgaaaaacacattggctattacctacagccaataagagagcaagatacaggacagcagggtggttgtggaggagttatagaccacaatctcagaataagctttaccataacactaaacaggagtttgcatgttctcctcgtgttagcatgggtttcctctgcatgcaccattacactgtggcgaccctcattaataagaaactaagctaaaggaaaatgaatgaatgatttcattcattgataacattaaacaaaaacaaagcagaaacctttgcagcagcatgttgcacgattattttttgacaaatgtgaactctgatctcacgtgtggtcttgagtgattaagcaaactttttgcggtcttttgcaagcttgacagagttgtctgcaattatttcaagggcagtaatgcaatgtttatcctcctgtcactgatctatcatgcagtgtgaacacagcatcaactgtatgctaccccagagagtcataccgtgtgaaaataaccgtgattcaaaaactttgaaattcatgcagtgtggcatttgacatgctatggtttgtttattttacagtgagtctttgctaattccatctcaccatacaggacctcgtgaattattcgttcattcattttcttttcggcttagaccctttattaatttggggtcgccacagcggaatgaaccgccaacttatccagtatatgttttacgcagcggatacccttccagtcgcaacccataactgggaaatattcacacacacactcatacactactgtcaatcttagcataccaaataaatctgtaccacatgtctttggaggtgtgggggaaactggagcacctggaggaaacccacgtgaatacagggagaacatgcaaactccacaaagaaatgccaactgacccaggcgaggctcgaaccagcgaccttcttgctgtgaggccaatgtgctacccactgtgccaccgtgtcgcctactcaggtaggctgaggtgttgacacaatgctcaattagtactaatgggcccaaagtatgctaagaaaatatcccccacaccattacaccaccaccaccaacctgaattgttgattcaaggcaggatagatccatactttcatgttgttgacgccaaattttgaccctaccatctgaatgcagcagcagaaagacctgcaacgttttttcaatcttctattgtctgattttgttgagcctgtgtgaattgtagattcagttttctgttctgagctgacaggagtgtcacccggtgtggtcttctgctactgtagctcatccacctcaaggtttgatgtgttgtgcattcagatgctcttctggatacctcagttgtaatgagtggttatttgagttactgttgcctttctattagcttgaactctgacctcaaaccattctctgtaaaccctagagatggttgtgcttaaaaatcccagtagatcagcagtttctgaagtactcagatcagcctgtctgagaccaacaaccatgccacattcaaagtcactgaaataacctttcttccccattttgatgctcaatttgaactgcagcagatcgtcttgaccagttcgttcacaaatctgattaaatgacagtcatgtgatattatactagcattgtctgtgttccagcctcttcacacttcattgtacaacataatgcacatttaagactgtttcagcctagaatgttagatttcaaatatgcagttaatagcctgtcaagagcaactgatgctcctgtgtaaaaaacatacatcttttcagagatcaacaaatccctgaaatacaagtcaaatatcttcatttatttctattctagacatatttatagttaactttattaaattgccaatacattaatgagagagcagttataataaggaggtccaccttattgactcctcttattttctagaatataagagatatattgttatctatatattgtattgagatgcagggctcatgttttattttatttcttctgtactagtacctgtcagtatttgcccggtgaaatgttctcgttttcctgtggttatctgtggctgtgtgtgttttccatctgctgtcttcctccagagtccctggtttcactgacagtcattaccagctgtaaattcagtcctgccaaggtgtgacactcctgctagagcagtcaatgtgcgtgtgtgctgcaagcgtatatacggttaacttccggctgtttcaccagattgcagtagacttttggatgagagattgcagtagcgtaaacatattctctgatgctctcacatgtcagtgaatctaaactgttcctatttaagttgatttccttctcaagcgttctggctgtgtgaacacaactaaagtaaacaaacagccaccaagtatcaaaatttgagtacataatttaagttaattgaattgtggtgtgcaatctatgttttgtgttatcataggcattgtttcgacttcatcttttgtggtctctgtgacacctgtgaatagatcacaatgtatgagaagagcaaccgctgaataattcaaacagcaccatgacatgtgtcacccgtgcagctcattagctatttgtttgttatttacagatgtaatatctatccatcctatgcattacacatttgacctcattgatgggcagcttgtgacatccaggcctttgcaaactctgagcagcaggtgtgagagcgatgtgtcagtccagatcgatgtgtagttcagaaactctatcttcctcatgtcagtctttagggttatgcattagagatggacatttctaagccttggagaggatcagacagtaattgagaattaatggtgatttattgatagctgtggtcgttgtttcatggccaactggccaccaggtggtgacgttgttgatggatctggtgaaattaataggatgtcatcatgcagttaaagtcaatattggaaaaaatcatatggaaaatatcaatagtttggggggttgcttttgctcatgaaagaaattaatattttttatttagatagaatgcttaacactttataataactacacactataaatcatttattaagcaataacaaataggaaattcattatttgttgagcattaactctacattaacagacattaataagcagtttataactgcagatgcaaatgatctgttattgacttataagcacatttaaaatgcgctgaataattgtcctttcatactttgtttattaatttttcactaaattaagtattgcattttttacaaatccttctaaactattcaaatcaacatttataattcttcttattcaggcatctgttaatagttaattgtttctgttaattaaagctttattaactcaacttcatgcagttttgtgacctagaggactatttatgctttataaatacctaataaatgataattcaagagttcacacttagatattgcttgacgactgtaagcaggtttggcatgctgtcccgggagagaaccctgagctcggagatagttgagcccagggctcccgccaggtccatagagcatgtaaggggagtacgagatcaggtggttctcgagagctcccctttttaaagggaggaaaggaggagatagggggtggatggggggtttcttcggaaaacgaaggtaagggagtaatatctagctaggctatttatagtaatttggaatagatctgattggctaactaatgagtgtagattggcggccagctgcggtcaattatatcacgtgctcctctcgaaattagtttaaaaacttcacttcaagagttcacacttagatattgcttgacgactgtaagcaggtttggcatgctgtcccgggagagaaccctgagctcggagatagttgagcccagggctcccgccaggtccatagagcatgtaaggggagtacgagatcaggtggttctcgagagctccccaaatgcatgaagctcgggacagcagccgtgtattcgaagaaactccccaaaaggcttgaaatgctatatccggctgctggatatagttatttgaaaggaaatgtaaagagggctccttggagcaaagggtgacacaggttcctgcgggaacccgagcagagttggcttgggctgtgaatactcctgctggagtagagactcggggagacccctgcgggggtcagagccatggggtgggcgggaatcctgctggagtcattacaagggaaggggagtgaaggactccggctggagaggggggtgaaggggggcagggggggggcggggactccaaaggagtaatttgctcgaggaacactccttgcggagattgagctgggaggtggcagcactatatataattatatatttatatgaaacatatagatatataaatatataatggggtaatctagggcattggggggggcgttttttttttttactgactcttgagagagtcgaagctcttggctctcctgcgggagagagagctgtatgtgccatctccagctggagtcgggaaaaggaatggtcggtgaagccccagctggagggtgaaatggcagttgggcgatgacccctgcgggggtccggtgctcgggattaactccacgggagttagagcgtgagggtgacagcactatatataaatatatatttatatgcgtgggtgcatatatatatacatatatataaataaatttaaaaaataaaagataaatgtgagaaataaacagaaataagtgaataaaagctagggccggggagggtcggtgacatggctagtgtcacagctcggggctgggtgagctatttggctggctccagtaggagtctggaaagatgaggggaaggtgaagactctttctggagggtgacgggcgctataggtgctctgggggtgttcctgcgggaacagagcgtgagggtgacagcactatatataaattcatatttatatgcgtgggtgcatatagatgtgaatttatacaaataaaatcaaacaaagagaaaataaatagtgctatactatatgtcattgaaatgacatataatataaaaagctaaggccgggccgtgagatgattcctgcggtaatcgaagctcggggtaacgcccctgcgggggccagagccatggggggggcggggtcctacagaagttagaaaagttggtgggcagtgaaaacttctgtggcagcggccagggggggcgggggtgacgggggggcttgggcagggaaagaactcttactgtagttgggtgagtgaaaagggggagaaggctgagtgcaaatcagctgaaaggaagaaaagaaattagatggctgggtcatgcccgcgcccttgagagacttggtagttcctctgccctcgggaagctggtatagctgggttgtgttctttccttgtactaggctcgtgtctttggccgctgggataactgcaacggctggtgagggtcctctgggcttccctgagatgactgtggctgagtcggatgtaggttttgaaggcgtcagaagaccaccttcctagtgtttgtatgtgttgttgtgataaccctttgtgtgctgctgtagtggcggctccaattctgaatgagtgactggagtatgattctgatgggaagcctgagttggttaggacatatttaaggtgtttttggaaccaaaagcgtgtcactgggtggtgtgtgtcgtctatgaaaagggggtctaggggacttgcacttagtgttttactgtagtgtgtgtaagctagaagagtttggaatgggcttgtgggggagggaatgttgaatatgtagatgtaatgtccctttctggattgatctgttttactttgcttaatgaggaaagcaattgtttcctcatcaatcaaggtcagatctgctatagtagggtggatagagggatcgaatttagatgtaactgtaaattcagaacatcttagaaatccaaaaaaggcaagaataaacattgcatctagggtatgatctgtatgaaatgaaaaatagcctttcctgattgtggaaatgcatttagctagtatgttgtgtgtgatgggtagccttgtgtctgggaggggggggcgggtcttctgaatgcctttaataagaaggctagtttgtgagttagtgatagattcagaactggagccgtacatgagtttgtgaaaaaactgaatgccacttaaatagctcttaatcgagtttgcctggatatgtttgtgagaatgaaggtaagtgataaatgatgtgattgtaagtagggagaaattggggaatgtagtgttgtatagtgaatggaaatgtttgaatgttttccatgcagtgagataagcttgtaaggttcttggagccaccgcttgcataatgagagatatggatgcttggtgcagatcgtgcatgggatgatttattggaatatcatctctgaataaggagggatgggcgtcgggtgctgctccgcctccggcgctaattctctgaatttctgaaaatgaagacgagagagagagtcagcaatttaattatgaaaaccaggaacatgtacagcagttaaaataaactgttttttggctgaagtccaaataaggcgacggagaagcggcattagagcgggggagtgagagcgccctctattaatgcagtgaacgacggcttcattgtcacagtgaatgagaatgctggaagcagaccattcatctccccataatagggtcgcgacgactatggggtatagttcgaataatgcagatgaatattggtgtgatggaacctctaacatttgggggggccaatcggatgcgaaccagcggccttggtagtaaccgccaaatcctatggagggtgcagcgtctgtataaagatggatgtctacgggggatgaaattaaatcactataaaagaaagaacagccgttccagcacttaaggaaggaaatccagaggctgagttcgtttcggcatggatcggataaggatatattttcttctagactctgaactgatgctgcgagttgaaggaggtgagtgacgaactggcgtccttgaggtatgatgcgcatggcgaaatttaaatgtcctaatattgacagcagttcgcgtttagaacattcttgtttctccaaaaatatggaagatagagaaatgatgcgatcgactttctctttgggtaaagatgcttgaaatttgttagagtccaaattgatgcctaagaattctatgaaggtgctggggccggcggttttttcttcagctagagggatgccgagtttggcaaacactgctttggtaatctctaggtgtttagcaggtggggaatttggaggggaaattatgaggaaatcatctagtaggtggactacgtgcggaatgccgtaattgttagcgaggatccagcataatgcttctgaaagcatgtcgaagattttggggctacttctgcagccgaaggttaaacggactgcaaagtagaattgggatttccaattaatgccaaagagatgccagaactcgggatgcaatggcataattttgaaagctgacgtgatgtctactttcgcgagccaggcgtcgcgtccgacgagtttaattaaagaaatggcttggtctatatcgtggtaattcagagagaattcgtcaggtgaaattatgctgttgacacttgaataggcggaattatggggagaagacaggtcgataattagccgttttttgcccgaaaattttctggtcgctactccaattgggctgactcgataggtgctaaacgggggggggcaagaaagggaccgatcataaatttattatcgatctctttctttattaattgctccaccacttctggttcagcgttagcagattgaaggttaggacatgcgaggttataggaaggaagagtcgaaacaccggggtggaatccattagacagacctgaaatgagaaattcagaaaaattaggatcagggtgcatgcataattcatggtaaagattagaaatattgacaggagtcgacaaataggatctatgttttttatttgctttccacacttggcagaccactcgagcatgagcgccaccgcagtaactgcaaatgtgtaagtatttgcaagggtggcggaaacatctggctgcgttaaagttattgcaagctagagatgatggagggttttgagaggagggaggggggagaagagcagggatagcagaggtggaagggcggggtacgtaactagtggatcttggggtttgtagttctttctcagtggaggggattatgaagggacaggaagtggttgggtgaaggtttgagcggcagaccgcgcaggaaagattgcggcatcctagaaaaactctgttatggagatcagtgtccaaagccccccaataagaacactgattccattgagcaacgcgaatagcgcattttgctgaaaataatttgtgatatgtatagaaatgcgttcccccataggagagtgcgagctccgaaatgatagccatatagtcgttcagctcgcgcctcctatggggaaagacagagcagatggtgtctgtataacgtgagaaagctacgtggaattcggctattgtgagtgtgcgaggttgagagctgactggtgatttaagtgtaatggtgaattcgccgcaatccacctgtcgatctgccgagggaggtgcaataggtgaaaggagtgtagagaggtctatgtctgcacctgataggatgaggttcctgactgtgttggagatctgaggtggttccaggactggagcgttatgcggaatgggaaggggtgtggctgtggctagggtgaagggggctcgtgcggaagatgtgttagtacagaaagcattttgttggggagggttagtaatggaagtgggtgcttggagggatgtagagggaaaaaaggggggattagtagatgaaaaattagcaggcagagggagagcgttggagcttgtaggaaaggattgagtgggaataagttgggttgaagaatgagggagattagaagaaagattgggaataagttgagttgaagaatgagggagattagaagaaagagagaactgaggagggttgagagtcgggggaattgcttgaagagtcggactggagttttcgctggattgtggggctggaggccaaaggaggggggtgggaagtcctggagtggcataattgtccggtggattcactgtgtgttggttggtagaaggtgctttctgtcctgtagcttgaggttgctttttattagttttcttggttgctttcttgggtggtccaggggggtttcttgagtgctgagtagcggagggttgtggatagggggtgtggcgggagcgagttggtctactgtcttggggaggcggagttggtgacgggatggcttcgtacagtttcagaagttcggatttattgcagcgggtggggatggaaattccggcgtttgtgagtgactggcggagttcagaaacagtcattttgttggatgtgatggatgaagatcttgcagaggcgtaggatgaagcgggagacggtaagttgcggtttggagatggagattgcgtgcggcgatgggttcttgtgactgtggagcggatgggtcttcggcctctgataggagcctcggtgtttatttgggtttgttgttgtgtttgggctggtgtttccgggagagctggtgtgttggttccttccatgttgcttgttgatagctttgatgttggattgttctgtttaggttgtgagttctttctgttgttgtcgctgttttgttgtagctgttgttgtagtagctgttgttgttgaagctgttgttgttgaagcgttagctgttattgttgatgtaggctgttgttgctgttgttgttgctgttgttattgctgttgttgttgttgtagctgttgttgtagctgtagctgttgttgtagctgtagctgttgttgtagctgttgttgtagctgttgttgtagctgttgttgtagctgttgttgtagctgttgttgttgtttgttgtcgagggtttcggtagtttgttaggagcagggtttgtccttgttattcggaaaacgaaggtaagggagtaatatctagctaggctatttatagtaatttggaatagatctgattggctaactaatgagtgtagattggcggccagctgcggtcaattatatcacgtgctcctctcgaaattagtttaaaaacttcacttaaaggttcagtatcaaataaacaatacatcgctgcaatcttatctaaaaagttaaattactgtgtcgaataacaggagtgtcaaaatataaaataaaactggataaaacaacactataataatttttacgatacagtatattatgatacaactttttatataatttagtgatgtttaaactgcacagtaattttattttaaattgcaaatatttatttttaatttgatacagattaatttgtgtatcttcaagtgaatagaaatgaataaagtcccttaattcctttttagtatataacttagcctttaactgtcatttataatggatttgtaaagcttaaatagtcctcactttagattaggtcacaaaatgggagaagtggagttattaagcatttattaacataattaactattaatatatgcctgaataattattttattaatcatttacttgcgcattttgaataatccgtaaaaaccagaaacttctcttaaacaacttgtttgcaatacttaatttagtaataaaaaatattaattaacaaagtatgtaggtaaagacattatattggtgcttttaaaaaaaagaggatttgtatctgcagttataaactgcttactaacatctgttaatgtagagttaatgcttaataaataatgaattcactatttgctaatttttacagttttttttctgattacttaagcacaattttgaaattaaggcccattttgtcaaaacaccacacacaatttacacatccacacacacaaacagcagaacacatcagaacttttgcaaaatgaaacacttcatccaaaactttacagcgctaaaacaaaacacaattttgacactgtacagagcacacacgcctcatttaatatgtcacactgtggtaatcaatcttaaacacttgtattatttctaactgactaatactgatataatcaggatttaagaggtattgctataaagtacatgaacatactgtatttaccaatcagggatagactgacagctaaatattccttatgctaacaaaccatacaacaaatgtaaagcctatttattcagccttctggtgatgtatgcatttcattgtaaaaaaaaaatcccatccactgtctcctgtttaccaatcttcctcactttcgtgctttcccttccatactgagacattgccttccatatttattgaacactaatattcaatactactgcaaacatgtttattgaagactaatagtttaaacctattgctttttgttgtggttccagctgatgtggtgtgtacagttttgcagcagtgtgtgtgcacacctgatggctgtgtttaacctatggttcatgtgtttgttcatttgaaggcctttgctttgaaattgcaaggaaataccgttatgaaaattttctatcaaaagcatccaagtgtgtttagtgatttgcatatcactgtgtgtaatgttttgcaaaaagtgtgaagctgacaacgtgcttagagttgtgcaaatctaaccttgtgttttgctccttgattgtacggttttgctaattgtgggaaaagtttaattttagtgtgttagcaatcatgaaaaactgtaacaaatgattcatagtgtgtagttattatagtgttaccgtatacgaaaaagtgacagtaaaaaattgtgttataagtgttttctatttgaagtaaatgctgttcttctttgaaattattattcattcaagatttttgaaaaacagagagcaccaaatatattatgagtatttgccatcacaaaattaattgcattatactgttttatatatgtgtgtgtgtgtgtgtgtgtgtgtgtgtgtgtgtgtgtgtgtgtgtacgtgtgtgtgctacttaaaacaactaactctttgattccctaaatttagacttcaatttcccattatattgtttgtttggcatttgacatcaacacttgactaaaaagtttgccctttttcagtaaactgcttatcagtcaatcttgcaagttttttggggggttttgagaccatgagagtgtgttgaattttcttcagtcatttcattcttttgtatatattccttgaaattgctgtaatgtatcacaatattaggcaaggcacgattatttatatagcacatttcatatacagtggcaattcaaagtgctttacataaacagaaataaaagagacaagtgtaagaaaatagaaacaaataataagatttataaaaataagaataaactagtgttgctgtattatcaaccaaatacatgcagcattgatcagcatataagatatataaaagccttaaaaatatatgaagtttatgtttatcaggagtcttgcatttaattagatgaaatgactgaaagggtgagctgtgccggagagaacagtacaattggattcagcactcatgacaaatgctgcaaatatgcagaaaaacgtcacattccagcttcagcccggctagatattattttactcgctaacgaagtgaaatctcctacttggcagttcctttgtattaaatgcatccctggagttagttttttgtcatgttttcaacagaggagcggctcagtgtccatttcaattatatggtagttactagttatcaagttttgttactagttattgtgaagttaccagccttcacaagagcagtaaataaataaataaatttgcacacatgtatccacacatcacgcatactgtacatgcaatattttgtgtaaggtttgtcaaacatggggaagcaaatagtgtaaaaactaaatattcacaatgaatagtttactcaagtatgttgccaagtaatgtgtattttcaccgtagatatggtttcagccggtttgagttgcttgagaaaacatgaatgaaaatatgtagtaactgaaattttatttgatttgagtcaaatacaatctcatttttacaacacataaatcagcttttttccacttacacaggcaaaacaaaatcaattcctgtgggagtagcaatcgttttaaataaacggacattctatactgtatatagcacgctttacattcttggaaaaaaatatgcaacaggattgtacttttaggggtacaacaatgtcacagggacagtaccctaaaaatctttgtgccttatttaccacaaaatattctgagtagtgctttaaaggcacaatacataataattatttatttaaaatatccaatacccctagaacagtgttatatattttgcttgctcatgtgcttacattgttacattgttcaaattcagagaaatatacaattttaactagttacacggtctgtgacctgtgtcgccattctaataacgtcacacaacctctttttccggtttggattgatagaaaattgggaaacaccaaagatgctttaatatgttgtgcattttaaaagactagtggatgcaaacaatatgtatagatttgtttgtctttttgaattttaaaccattccgcatctatagacatagcaacaagacaaccttaacacattgtgattgcaactgttgaaaatgaaaaaaatgcagggagcaaatgtatgtttttataaaaaatatgaatcgtccttgctcctgatgatacattgatggagtgaaataatcaaagattgaacattactttgaatggcagtcatttatttaaagcatctgatcatctgtgggtttgtggcggcataaacatcttcagacaacagaaagtgcacattcctgttttgcctgtatactgtttgcttgtctgtttttttttgactctcaaaacgctgccagatatttacttatgttttattaatcactaagcccatggtttcagtttttaaaaaaaattaaaaaaggaaataaaggaaaagtaatctagcctatgttatggataagtaaattaaccgcaaattaattatttttcataaactgcttgataaaactgattaggcaggcctgtagccagcctggtgaaaaaggtggttatattttctcaaaatgtgaatcttttaaagttatttacctcattttctatttaattagtgacattttaagaactagttttacctggattagattgtcgggtggtcatcataaccacacgttttaatgaaccaaaatatttcctaaagatttagaataacgaaataaatactgaataatgaataaacacttatttttaaaatacaaatgtattacattagaaaaaaatagaaatccggtaaagttttaaattaaaaactgtactctattgtaatttattaggcaaataacaaactggcctgtgcattcaactttcttcagtcagaatttggtcctttaaataatcaaaaattgaaacattaaaatggtaattttttgtttcagaaataaggtcccagatcaagaatagatgttacttcacatgacttcagattgcatgttttcttgcacagctggctgttggactcatgaaaaataatagttagcatttgccaaaactgattagctgaagtcacaccgatgtgacggtcaacagagcttttcgcttggtcttaaagcctttttcgatgggttattttcacaatttatgatggcatagcaatcaaaaaaggacaaatgagctcatgtaagggacttgtggacttttgtcagtgaggggtgggtgggtctttcgaaccattgcgacatcgatgctaaaacaatatatcgtgcaaacccttacaacttatatcatctctagtatgatatgatcacacacacacacacacacacacacacacacacacacacacacacacacacacacacacacacacacacacacacacacacacacacacacacactgtacacaaacacagatagcaaaaaggactgtgaattctccagttctgacctctccaacaaaagactagtgacttgacaaggcgggacgcagtaaattatggagcagatgaaagtcaattgtctgttgtttgttcagaagatcaataatgtatgtggggcctttagaaaagttgatcgggagccagaacctgatccaggatcagtgaattattcacccgtggacgcatacagttcacagacagtcacaaagccatcatttctccagtgaactgggcacatatcaatcacaattgcctcttatatcgagtccctctggctgaacaatggtgtcatttcacattccagtaaagctgtagctgtagctcagaggcggttcctaaaactgtttgccgttaaaatggattgatgtttttcaacctcacttgactatatggatagactcgcctgccttaagacagtgatgcagtaatagatgagagagcatgggttacctaactacatgtgacatttaattggtcattctagaattcctgatttatttggttcagtgcctgacacagtcttgaattaacaatcagagcaaagacacttcactatctcatatgtctgctgctgatcttcttttaccctgatttgttcgtctatgtgcatctaaactaaagggtagacattatggtcataggtggcgtggtagtgcagtgggtagcgctgtcgccttatagcaagaaggtcgctggttcgagcctcgactggctcagatggcatttctgtgtgaattttgcatgatctcccgttgttcatgtgggtttccttagggtgctttggtttcccccacaagtccaaagacatgcgttataggtgtactgaataagctaaattgtttgtagtttatgtgtgaatgagtgtgtatggatgtttcccagtgatgggttgcagctggaagggtatccgctgcataaaccatatgctggataagttggtggttctttctgctgtggcgacctcaaattaataaagggactaagccaaaacgataatgaaagaatgaataaataacaacagtaataataatgataataataataataataataataatagtaataataagattaataataatgtttcttgatcaccaaatcagcatttctaaacaattacgtggcggtgaagtaacaatgctaaataattaaactttgcctttttaaaacgtgataataataataataataataataataataataataataataataataataataataatatgtagtgcttaatgttgttgtttgagcataaaaagtgtgattattttctttatgagaactgtacatacagtaaactccaacaattgtctccagattttctttaagggactgtgtgtcacaatttcttttgtttttgttttggtttagcagtgttttatcagcatgtttgagagatgctgtttcacatatccatacctgtcaacattgggatgtgaaaataagtaaatagtacattggcagcaagtaaaatagcaaacagttcagcttattaaaattaatagcaattataatgtaatagaatcaagttatcaaatctcattagccatttctctactgtatgacttacacattctgattacagcgtagcgaatgaatgatttatttagatttttttgttgttgattacattaaataacaggtatgtgtcactttaaaaatgcacacatctaacgttataataaaagcattcgattgctttcctaactttttatgctcatttaagacgaaattacttgtgtttaaaaaaaacccaccaagatcaacatctttagatactattattattagttatgtgtatatctgtttaaacacgctccccaaacccagacttttgctccgctataaatcgtgtgtacagaatctctttaggaaacagcgtctatttatcactattgagcttgtcagctgacagtcatgcaccgttatataactgttttgaggattgcatatgaaggggagacggcacttataatgaaaaggaaggtaatcaagcagtttctatgtttatttcaaagtgttttcatgcctaaacaaagcaaaagcataaaacagactcacatttaagagcaaggggcggcccctggtggttcggcagtatgggttgagcatagggaggcttggctctttaatgtttatttgccacccttcagtgaaagactgaaaatacgggagaaatatgggaaatacgggaatcccgggaaaaatggcagggttgacaggtatgcatatctaataaactgatccccagctgttaacattcaaagaaaataaaaaaaaatgatgtgtgtttttatgtacttttgacataaccttaaatggatttgatgtgaaagatgttttttacgctacggggacaggagtttataacgacaagactttagttctttaactggcatcacaattgcccggttggcctcttgcttatagggtatcatttaaacaaaaaaactaaacaaaaatttaagtggtatcagaaacgcaatttaattaaatattagtcaaaaacaaaaaagagttaaagagttaaaattagcttttttgtttatttgttgtagccagcttattcaatgctcaagttggcacctccctcttctggaagaggggttggagaggagcagctcatttgcatttaaagagacacacattgtttaataaatggtctgtgtggtatttttagctgaaagttttgggcacattctgaggccctgtttacacttatgcgttttagtattaaaactgtgttttagatcaaaaatgatccacgtccacactggcatttcacctagtgttcacacttcattgctaaaaacgcaggtcacatgaccacacacacactctggcatgcactgcatcgtatgccccaggcagtcagcaggtgctttgagcacacctccacagatgagaggtgcacgtcagtcagttaaccaattatcttccgctggatggcatctcactatagttgttaaacctgatatttaattgatcttgtctatatctaatgactctttggtcttttgaatctataacttgtttttaggtagtgcgttttggctgagtgcaaagaaagtcaatataataatttatgtaacctcgctgattctgcacaattgactgattgcttgcttttatttcctacattgtataaacgtattgtatgttatacatataatagccattattcattattatttctgatattcagcatataatatcaaaatgaaaataagcagtgccttatatcatgtttttattttattgttaagatagtgaaacaatgcagccagggtgacgtgaatgatgttataaagtccatttgaagatttatctgaagtgtcctcggaagtttgttttccatatcaaacttgtgaagtctgaacttgagcttgaactaagtgcactagcctaatattgaggaaaaagccccaatcagataagcgaatgtctgcagctatgcctctgttttcagaagtctctgtttccctccccatccacactaacatggagcagcaggaaattaaaatcaaaacggcctcttcaaaacacttcatttttagggctcgaaaactctggggttgtgtggacggaaggcctaattgtagcaaaacttaaaaaatggattttaaaactaaaacgtattagtttaaatggggcctaaaacaccatattttttaacaagggaaaaatatttcacatattttcacagtgttgctgtttttcactgggtctttaaagctgtcacaatatatcttcttcacaagaaacacacgacccttacaagctccttgcacattgagccaaaccagcgtgagaggagattgttatttaacaactgtctgactgaacttttttgcgttaacaggttaatcggcacattccgcatggttcttcagaaggtggtggaggagggacacctggaggtgtctgacacactcattgacgacaataacacagccatacaggtgagacacgaggaagtgtgtgtgtgcttgttttgttctgctctgacagtccagaaaagctctttttcacccatacaaaaacatccattcacatacttcaccgcagcgtctagatttgcacaacttgcacagtgaaaagttgttgtcatggttacatgtctacgcagagcctatagggcacgattcagaaaatgttttattctctgtctagcatccactttcctatgcaggttgatgtctatagggcttctgctcatctttttgtgttactgtaagttgagtaactcggacaagaagcacagcacatctttaaaaacctgttttctaagagtgtacgcacatcagtgggaccgtttagtgcagggggtccaaacttggtcctggagggccggtgtcctatatattttagttccaacccgaattaaacacacctaaaccagctaatcaagctctttctaggtaaactagaaacttccaggcaggtgttgaagcaagttggagctaaactatgcaggacaccggctctctaggaccgagtttagacatccctggttttccacagtgcccagctatgactcaggacagtattcaaattccacagagcaccatctgtagttttttattaaattttattaaattcacagggctctattttaaaaatcttaaagctggtccaaatccatttttgctattttaaggattggaaaaatggcattgtgtccagcgcaatctctaaatgggttgtccttattctcttatggctttgaggtgataacgtgtattaaaacaatcagagtttgatcccccattccctttaagggtaagtttgtcatgatcaccagcgatctaaacacaatagattgctgaaaaacatgcacaatcgctaacagactacaaattcgccatttcattgagtacaaccccatacatgcactccgctcacacacacatgttcctgatcctgactgattgcatacacaccaccggaggattgtcaaggactgattacacaccctatttaggcagcacatacctcactctagtcgccaagtcttgtttacattttgtgacattaaaacacgtttcctttgtcttgttttgccatgttttgacccttgccttgtttatctatttgtccctgtctgctgcctaccttctgaccactcacctgttactttgacaacgtttttggattgcctctgtttgcccatgttgaccattgcttgcctgacctttctaataaacctgcatttggatccgcacccctgttgtcagcatcccatcccttgttacaaagttgcagtcatggaactgtttacatggtagactttgtaagcagaaaaaactaaatgctttactggcgaagaaatagatctacttgtttgcgaggttgaagcactaaacccactctctaaataataacaaaaaaaaaaaacttacaccattgtaaaaccagcttcagatttttgccttaaaaatcatactatttgctctattatactaggttagtgtctaattgaacaattgtgctccctaatactgttaatatactataaaccagtgtgctgttgatatgagacatttattaattcattcattttccttcgtcttagtcccttatttatcaggggtcgccacagtggaatgaaccgctaactattccagcacatgttttatgcagttgatgcccttctagccacaacccattaatggaaaacaccattacaatctcacattcatacacgcactcatacactatggccaatttagttcatccaattcacctttagtgcatgtgtttggactgtgggggaaacctggaggaaatccacttgaacatggggagaacatgcaaacagaaatgccaactggcccgaacgaggctcaaaccagcgaccttgttgtgaggtaacagtgctgaccactgagccactgtccagcccagctttacatttgcctttatttattaaagcaggggtcatatctactgtaaagcctcagcagggctcaagttctccttttagtaagacatgtaccctgagaagtgaccatcagccagttgacagaataggctggactaaggttaaattgttccttgttccttctaatgagattgtatatgtgagaaggaaagagtaaccgatgcgttcagactgatactgccacatggttagcatgaccctaaccttaacacttactgtaactcacttacaactcacatacacctaaccctaaaccttatccttctacctttcctcagctttcttttgcttgtgaagcttaagtattaagtaaatacttaagtaaatgtattcacagtaacttttacaacattatcctgaacattgttagcattacagttttttttctgattgcttgagcacaattttgaaattaaggctcattttgtcaaaacatcacacacaatttacacatccacacacacaaacagcagaacactcaggacttttgcaaaatgaaacacttcatccaaaactttacaacactataacaaaacacaattttgacaccgtacagaacacacacgcctcattctatataaatctgttttcttgtatcatttttaactgactaatactgatataatgagtatttgagaggtattgctataaagtacatcaacatactgtattcaacaaacagtgatagactgacagctaaatattgtcctattctaacaaaccatgcaacaatgtaaagcttacttattcagctttctggtgatgtatacatttcaatgtaaaaaaaaaaaaaaatccatccaatgtctcctgtttaccaatcttcctcactatcgtgcttcctcttccatactgcaacattggcttatttattgaagattaatatttatagctcctataaaacaaattcattgaagactactatttaaacctatacttctgtaaacatgttataacaatagtttatacctattgctgtttttaaaacccaggctcattctacaacctagtcccacggatgattcaatcgactgcgaaatacgtctgggtaggtacgtatttgtgcagtttttgttttcgcgaataatatattttcgcgaataacaatatattgtttttgtgtacgctttttccgcttctcgaacatctcttgcaagcgcccacgctgttctcacataaagccaccggaggccgctgtcgagtgaccgtttatctggctgactgactgaatgattgactgggcgaccggccaattagccgacccaccctcctcttccttacctaaacccaaccggttttaccaattggtaaaatcgcttcgcttaaaaaaattaaatgcagccatttgttcctccgattacttaaatcgcgttcttcagaaacgtccccaggattacgttttcagaatgagattgtgttgttttttttatggtggttccagctgattggtgtgtctacagttttgcagcagtgtgtgtgcacacctgatggctgtgtttaacctatggttcgtgtgtgggttcatttgaaggcttttgctttgaacttgcaaggaaataccatcatgaaaaatatctgtgtcaaaagcatccaagtgtgtttagtgatttgcatatcactgtgtgtaatgttttgcaaaaggtgtgaagctaacaatgtgcttacagttgtgcaaatctagccttgtgttttgctccttaagtgtacggtttggctaattgtgggaaaaagtttaattttagtgtgttagcaatcatgaatactgtaatgtcatgggtcaaaaaacaaagctaggctcttgagagcaactgcaaacatcaaattcattttattttctgtgcaaagaagttttgtttttaactattgtttcaagctgtgttcacattttgccaacaaagcaattaaaacaagtaagaaattcacaatgcctcgttacagttttttccaattgtttacacacaattacttgtacttcagacacaatgactacaacatataactgatgcaccaaccccctgaaccaaatactccattcctcaaacctattgaggatttatttttctgcttggagatgtaaagtgtatgaccgaaatccccacaaacgtataccccttctccaagctctagcagttgatgcttttcgtgactggatttgccatgcaaagtgacatttcccccactgcttggccagaccaaaacagaaaagaggatgcagtatagctgttttttattttttatttttactgtaactgaattcagtaaatacttctagtgatggtatatgtagaccacgatatctgcaaccttgtgttggttggcatgaacactgtgtacacagtttttgtggggaaaatacagtaaactatatttggtatttgattgttttgtataaaaacaatattctgaaatattttacaatacacttctgtaggcctatgtactgtctgtagtaagtgtaagtctgagcaaaaaaaggcttacagaaagtcattatgatgaatggagaaaaagtggtcatggtgttttacattaagcacatcagtgttcaactgatcttatgaatgtctattcatgtgatggtttgtgtgtgtcatttgaaaacaaaagaccattttgagaagaaatcaaattgttttgaacgtagagtttcattttgcagaagaattgaagagttttgcccaatatgtgtgtgtgtgttttgtgatttgtgtgtagagttctgacaatatgagacatattttcagaaaatgtgtgtaaacatttggaaaaaactgtaatacgatttatagtatataatatttatattaataaaaggtattctgccttttaaataatggaacaattatatgcattgatctgtatctcattaataataatgatatttataaaattagcaagtttataatagtaaaatttgaacatcgagggttcatagcattgtgaatgcatgatagttaccagcagtgatgcagggaatatttagttgccagtctgaaactaacagctcactgtttaagtgttcaaaggacacttttcttgtaaaaacagatgtttgtatacacttaaagtcgaaattggattcatagtatgtattttgacagatctgtatgcctgcaaatggaagctgttgcatcctgcaaataataataataataataattccttaaatttataaagcgcttttctggacactcaaagcactttacacattttttgggggggaatctcctcatccatcaccagtgtgcagcatccacctggatggcgtgacggcagccatattgtgccatattgcaccaggatttttaatgaacacagagggtcaggaccttggtttaatgtcttatctgaaagatgtcgctcactgagcagtatagagtccccatcaatatactggggcgttaggacccacacagactgcaggttgagcgccccttgctggtctcactaacaccacttctggcagcaacctagctttcctaagtggtctcttgtctaggaactgaccgggcacagccctgcttagctttagtcggtggtcatgtgagagtagcagagagctagctgccggctaaatatgtccccatttagcaaaattcataattttatatcaatattaggccatctttgagaaatgcatgtctgttgaagtagcccatcagagattactgttggtcagaatcaatcattattataagcatacacaaactactgaaaaaagcagagcagtggaatttcaatgctagcgataatgaaaatgtagacactctctccaattaaatactctgtgatggcatcatcgttgtttgagtttgaagtgttgtaagttcggggctcagctgggatgttttgaagatcccttttagatgtcattgttgaaggtcttttaggttcctttagtgaaaccagtctctccttcacctttgtctggtaatcttgtctccaccaatagtcgccagacctgaagtttgacattataaaaacagatggttttgatctaatatacagtgatttgattatacatacatggggcagttgtaggataatgattagagttgaacttaaaatccaaagagactgatggtgaggggagcgctgtaaaaattattgcgccaatttgttattacaacctaatattttggggtgaatgtgttggcatacttaaagttttacctgacttaacttattagaattttaaaaaagcagctaaactcatatacagttgaagttagaattattagcccccttttgatttttttttatattttgcaaatgatgtttaacagagcaaggaaatgttcacagtataagtctgataatagtttttcttttggtgaaagtcttattttctttattttggctcgaataatatcagttattaatttttaaacaccattttaaggacaaaattgttagcccctttaagcaattttttttgactgtttacagaacaaaccatcattatacaataacttgactaattaccctaacctgcctagttaacataattaacctagttaagcctttaaatgtcactttaagctgtatagaagtgtcttgaacaatatctagtaaaatattatttactgtcatcatgacaaagataaaataaatcagttattagagatgagttattaaaactattatgtttagaaatgtgttgtaaaaagcttctctcagttaaacagaaattgggaaaagatttacagggggtctattaaatgagggggctaataattctgacttcaactgtatattagttaactgcttcaaaacattaacatttaaatagtacagatatgtgcaaatgaaaacaaatatattgttattgaaataaatacacttaaatgcatttgtatagaattttaacaaaaacaaagtgtgtgtgtgtgtgtgtgtgtgtgtgtgtgtgtgtgtgtgtgtgtgtgtgtgtgtgtgtgtgtgtgtgtgtgtgtactaaaacgtacttgttttaggattatttttgtttggacagttacagctggaaacattcaagcattttcaactattcatcattcaactattatgtttgtttttctttttcattcttttataacccggttgaacacattttaatctggttttatctgttttagtcatttttacttttttaatcatttctattttcttgtttcttttattctgcttttatgtaaagcactttgaaatacaattgtgtatgaaatgtgttatgtaaataaacttgccttgccttgccttgccttgccttgtatctggctacactgaccaccattttctcattgtaatattgtggtgtgtgtttgtctgaggttcttctcagatacctgcttgttgggtaaaatttgaatttgcagacttcaggggctcggtggttagcactgttgcctcacagcaagaaagtttgcatgttgaacaccaagtttgttctccccgtgttcatgtgggtttccctttgggtgctgtggtttccccaaaaggcatgtgatagaaacagggtttaatttgggccggaacaagtctcaaacttctgaagtctgattcagcatctaattttactgatcctcctccccggcccactcttaactttcttccgagactcttcaacactctttactttcgtccgcccccgccactgttcgatttctgttaccttgatctattccaggacctcgcaattcacaaattaagcactgagtagcagtgaattgaataaacaaaattggctatagtgtaagcgtttgtgtgaatgaggcagttaacatgagttaagacaacttcagtatttaagttcattaaacttaaaacatgtccattacacttgaattataaagtcctgtcaactttaagacaaacatacaattttaaggcagcacgaacacttacatttttaagttgaaacaacaacaaaaaaatgtacaatgagtgaatgaacagagctttctttcaccttcaataatttgaagaatttgatgatttttttcaggaaacttatactaaaaggattttcaagaacccagaagtgattcttctacagaaataattgccaaagacattcctggagacccctaacttcttaatgggtgtgccttccaaaatgtacagtgtacaaaaattaatattaattggtatatattcttaaacataggctcattttgaaaacgtagccctatatacatttctggaaattgcgatttatgtagccagaaaagcaaatgactgcatttcatctttaaaatgaacgatacgttccttttagcgcttattagctgactgcttacctttgtattgattgctttcccgctgctaccagtttggccagttgcttgccatgtacgtcgggagatgcagagaggagttgaccacgacggcggcattcgagtgcgtcgaagaacggttacagaaagcaggttacacaaaaatagaagccaaaaaagttaaataaacaagtaaataacaggatgagaatgtggtcaaatctgaaaacaaggtaaaaatcaggcaaggacttttcgtttttttggattgctttttataactgtcggttgggtttagggaagtgggtggtcgggtcaacctgtacttttgacaacaatattggtcagatttagggaaggaggagggtgggtcagttgatcggtcagtcagtcattcagtcagtcattcagttgacagcagcctctggtggatttacgtgagaattgcaggcacgaatggcactcgagagagatcttaaaaagctcacacagtggcctctggtagattcacaaaaacaaaaactgtaaaaaataaaacatagcttctgtgacatatttgtcacaaccagcgatcgcttcccagaggatcgctggttctcacacgaacttgaaactacatttccgcatttcccaggactacattttcacacatgcactgctcccaaacacgcacacctgctcactcatgtttcctgattgcttcaccagctggaccttgttcacagactgattacatcccattcataagccactctctcacactaccagttggccgagtcttgttttccttgtgtaacattacaacgcgtttccctgtcttgtttctccgtgtctcgataccagccttgtacctttgttatcctgtttagccgcctgcctttcgacctttagcctgtttaacgtttatgattctggactgcctgtatatacctgtttgcacctgatgaccattgcttgcctgacgtttgaataaactgcatagtggatcttacctcctgtggtctcctgtcactccaccccagtcgtggttacagaagactcggccagaacatggatccagcgggtgttcaaatcatgcgtctccgtcaggaagcccggtcaatagaggagtacgtggaggactttattaatctggcccaccgtaccaccctgagtgaggtatgcctcatgattttctttcatggcggactgtctgagcccctatactccaacatacccctgtacggaccccagtggtctttggtgaactatattgatctagccctgcagatgagtggatcttccttcaccataggagaagtggacgaaaatcctaataatcttttggggggggggggctgtagagagcaagacccgctggctacggggcttgcgacccattgtcctcagctagctcacaagatggccgctcccagtcagccagctcacaagatggcttccagttcaaagtctgttcctgctcctgaaaggccatctccagagctgccagatcctccagtgctgccagatcctccagagctaccagaccctccagtgctgccagaccctccagtgctgccagaccgtccagtgctgccagaccctccagtgctgccagaccctccagtgctgtcagaccgtccagtgctgccagaccgtccagtgctgccagaccgtccagtgctgccagaccgtcctgtgctgccagaccgtccagagctgccagatcgtccagtgctgccagatcctctagagctgccaccgccagagctgccaccatcagagctgccaacgccagagctgccaccgccagagctgccagagccgacgccgcagccaacgcctcagccagagctgacgccgcagccagcgcctcagccagagcctacgccgcagccagcgcctcagccagagccgacgtcgcagccaacgcctcagccagagccgacgccaccgccagcgcctcagccagagccgaccccgccgcctgagcttcccgagtggtcgccgccgccgcctgagcttcccgagtggtcgccgccgccgcctgagcttcccgagtggccgcggtcgctgcctgagcttcccgagtgtccgccgctgcctgagctacccaaacggccacagctcctcgccctgtcggctccctacaagcctccaactctgccggctcctcgcagcactccaggtccttcgctgccacacgatccaggaccactgcagctccactctccgggtcttccgcagctccagtttccaggccctccgcagctccacgccccaggtacgccccagctgcatggtcctggccctccaaccctccccctgttccgcctccgctacgcctcccgcctgaacagtagtggagtgtctggaatccactcctagagggggggctatgtcacaaccagcgatcgcttcccagaggatcgctggttctcacacgaacttgaaactacatttccgcatttcccaggactacattttcacacatgcactgctcccaaacacgcacacctgctcactcatgtttcctgattgcttcaccagctggaccttgttcacagactgattacatcccattcataagccactctctcacactaccagttggccgagtcttgttttccttgtgtaacattacaacgcgtttccctgtcttgtttctatgtgtctcgataccagccttgtacctttgttatcctgtttagccgcctgcctttcgacctttagcctgtttaacgtttatgattctggactgcctgtatatacctgtttgcacctgatgaccattgcttgcctgacgtttgaataaactgcatagtggatcttacctcctgtggtctcctgtcactccaccccagtcgtggttacagtatttaacgctctcaagaaatgtttatagcgctacgttttcagaatgagcctgggttgttattcttttacagtactctagccaaaactgctcatatttatcctaaattattcacttacaagcttttaaacacttatggcactaccatgcacaagacactaggcatgacgcaagtgtttttttgtcactagcaatgtgttatttaaccagtgttgtttaaattgctaatgcatttgcatttgaccattgcccaaccaaaagctggtctaaaatcatgcttactgtacagtatgtgtgcattctatacatgtcagacactgtatatttattccacaaagcaaaatgttgtgatgttgttttttttgtatcttttgggacatatgcagttatacaatgctctttccttgaagcagattgctgtaaacatgttggataatgtgcaattgtgtcattaggcttctttgtaaaatgaacaaatagttacctaaatgtaaccaatctatttaaaattacagatatgtaaaataaaaaacctataacattacaaatagcctcataataatagtgataatcacatttttacaaccctgtggtgacaaattctaggtattcattaccactctagacaaggcttagaggatcataatgtaaaaatgaataatgaaggacaaacaaagaataataaaaaaaattatgtgatttttatttatttatttttttattccagctcaatgtgaagctattcctctgcctaaagtgagtgccacagtttttttgttgttatttcaggagcaagttaatttggtctacacattgcatattacacaagcaggaatacagcaaagctctaaaatattgttaaatatgaaatattaaagaaataaaatgtaaaagattattattgtctatataaaaataaaaaagctacctcctcctatgcacgccttcttcccttcagtggattttgatggaatctggttcgttctgtagatggtctgctcgcgcactttaacctcaggcacatgcagatccatgccatggcacaattgcaacttgctcataaagggaatgggatgagatgagactctgattagtttaatgcatgttacaccaaaaacacacccttgactaataaagagtttaaggacctctcttttagaccatgcactgacgaccaatttccctgaccttaaaaaagcaaaagtgggtttggacaccattaaatagatctaataaactttacacaaattgccattattacttgttatttattgttgttattgttatttttggctagttgctagtgagattctgaatgttgttattatggttagctaaaaacttaattgtttggaggtactaaaataacaaactaccaaagaaataattattactaaaaacacatacaaacaagtaaatctttaatttaaaaaaatgaaaaataaaaaaatgaactgatattgattataacctagtaataacatataataatagtaaaaaaataaaatactcctaatacatgaataaaaactacagtagtatatagattatgttaaaatctacttccattaaaatgtaaaattcatgcaaatgtggtgaatctcatcaaaacattcaggacaacagactacagtacctgctttctacgaatttcagtcttttaataatcacataatgctgtgttgtggttagcatatatttaaattaattgtgcaacttcttgtgcatctattttaaaccatttttaagatattctttaagaaagttcaccattcacattttttcctaagttgcatgtgaagctctgttggcttttcagctaatctttacacaataaaacataaacaatacacattatacagcaaaataaaattcaagcttaaaaaatctaaacaaagctgttaatttatttttattaagtctttttagctgtccaaagaaacctgggcctaccttcacttgtctttgtcctgatgatgtgctatagtgttgaccaaaaaccttgttttctgatgataactaatcaacacatgatgaaggtttctctctgactcgagacgtgtttagtaaagcctttttgtccatttttaaccacaaatttgttgccacagttattgccactccttcacccattaagtagatggtatgaagtggaaatcaaagtgctttattgccaatccctttttaaaactgcttccttttcccatcatttatataatgatcttctcaaaaaaaaaaaaaaaatgtttaagcctgtggttatgttcacattttgccaactaagcaattaaaacaagtaagcattatataactaaaggcaatgtgtacaagttacattattaataagaattatatatattatatattaattatatattaactaaatggtgtctgccctttaagtaacagaaaaatcatatacattgatgtttatcttaaataataataacgataattaaaaaaatatcaagtttctaaaagtatatatatttgaacatcaagggttcataccatcgtgaatgcatgatatcgaccagcagtgatgcagaaaaatagtcagttgactgtctgaacagactgtctgttagacactaagtgtttaaaagacacttttggatttacagtatgtattttgggtgtcactgtggcgcagtgggtagcagctgggtcagttggcattgctgtgaggagttggcaagttctccccgtgttggtgtgggtttctactgggtgctctgctttccccccacagtccaaagacctgtggtataggtgaattgggtgagctaaattgtctgttgtatatgtgtgtgaatgagtgtgtgtgtatgctcagttaaagtacttgggttaaaaatacctctacatacagtataacccaactatacgttattataccaccctcccaacaatgggttattttaacccaatgcattgtgttgtataatttaacccaatgtattttttttttttttatttaatgttttttttttccattctggtattacttttgctactagtactagtattcattttataattaggactgtgtaaataaaaaaacatatttccaatacattttaagttccagatacttaagcgtttttattcgtttaatattgatcggctatgaagcgcttatttgtatcattaatcattaagagtccaggtgaaacctatagactgcaaaagatatagatgttgtatccatgatgccatagaacgcaaaagaagctacaagtaggcgtggccaacagttgccattttgttcgagcatcatcgcaccaaccggggaataccaaacaagggcaaggagcgggaggattagcggagctacagacgcctgctagcattttgcttagacaggcttttctgtgggagaaatgcttaatacttgattgcctgccacttgtttgtgttctgaccacacacatgcttggttgtgtactatattaataaagtgtttaatcttttaaaaaacactgttgtaatacattgagccactaaacattgttcttatgacatttttctacaggaggaaaatgcaaattaattccaaacactttaaatatagtctgtattagtaaatgcaaggatatttatgaaatccaggcaaaacactgcatgacaacgtttcagatgactgttctataacctacagctaaccaatctgtcagattctggagtgcattacaggtctaaagaaaaatataaatgataaatgattttaaataaaacaaatacatttatagatatgatatacaagtatattcactcagctgggaaattgaggctaggtgaatggtttgtaagcacaattaagtgcacacagcatgccatattatctgatgattgtaagaaataattccaaaaggcaactgagtaaagccacataaaacaaaacaaaaataggatgtacatgccaggttaagcggctaatcagccgaaatcagctgagatgaagtgatggtgaccagtgagactgttgctgtcactcaagtggtcctgccccgaaattatgcagacctgataaaacttaatataaaggaaacggatgagttataaaaaaaatcactctcatcacagttgtcatgaagggtaatattagctatatacaccaaaattgttctttgtaccaggctgtacataccttttttctgctgtatgttggccgttttaacagtgggctcaatagaaatttgctctgttatggaaccaggactaggcgaggcagtggcgcagtaggtagtgctgtcacctcacagcaagaaggtcgctggttcgaacctcggctcagttggcgcttctatgtggagtttgcatgttctccctgccttcgcgtggggggtttcctccgggtgctccgttatcccccacagtccaaagacatgtggtacaggtgaattgggtagactaaattgtccgtagtgtatgagtgtgtgtgtgtggatgtttcccagagatgggttgcggctggaagggcatccgctgcgtaaaaacttgctggataagttggcggttcattccgctgtggcgaccccggattaataaagggactaagccgacaagaaaatgaatgaatgaatggaaccaggactagcggaatttcgatgaattgcagtttcagttatttccttatttgcttcacgagggaaagcgggaggttgccgcttaagtaaaacgattattaaaaaaacaacacggagagttaatttgatgaaaaaatggcaatgttactgggtttgagcttaaataaactttaaaacgcaaaaacaacattatatacacataataaaacaactgttcagtcagttaaatcagttgacctagctggttgggttattaaataaataacccaataaaggttaaaaataacccaacaaagcaccaaatatttaaagagcccatattatacatgaaatagggtcatatcctggttgtaagggtctccaacaacagtctaatatgcatgcaaggtcaaaaaacactttcatggtcttataatctgcatttatttttacctaattatcccagcgactcctgtatgaatcgtccagtgattcatttgttcccaaacccctccttagcgcggagctaatctgcgctgattggaccgatgacagtctgtcgcgattggtcgactgccttcagtcagagagggaaatggccaatagctaatcagcaatttaaaaagtaatcacagttcatacacgctcgatagtgcagacgtggattttagctgccacactatggcgagtggatagtgccacggataaccgaacgaaggagacagtcgtgtactggccataccacacacacacaaaaacacacacacacctccggatgacaacgctcccgcttccgcccgcacccgccaggttttagcctgagaacccgctccgttttctgcccgccgcgcccggtcccgctagagcggagaacacaaccaaaaatcacccagtatacagtccagacagccaagctgtcgttcgttcgttcgctcgctctctctctctctctctctctctctctctctctctctctctcatacgcgcgcgtgcgcactaacacacacacaagcaccacgcagactctctctttctaattcgcatagcaatatccgtgatattgctagacagcccgctcccgtcccaaattaaacccgttaccgaccgctcccgcgatttattcggaaatttattcccgcggctgtccccgcgccagatttctgcggcgcgggaataaatttccgaataaatcgcgggagcagaactctagcacggagctccataaacaaacagcacgcgtcgcgtttttaacgtgactttgcacgcgataagataaaatatccagttaacctgatacagtacacgcggttacaagtaacaaatcacaactaaatacatttgcaagctagagtcaacgaggcaacaactttaaccgcacgtacttacacttgagaaatggaagaaacccatcctgatgtccatcagtaagttactgatccttcctttaacaaacgcagatgaagtattctttgtagcatgtagcttccagaagtttccagtagtttccaactgcttggctataatgctgaggtttcatctttgggtagagactcaatatatccatctgcaatgtgacttcaatcgaccggcatgtttgtgtgcgtgtgtttgtgggtgtgtgtgtgtgtgtgtgtctgggttactgcgtcagagggcggggcctcaggtttgaaatctcccgggtttgcgcgtgcacgtgaaaaactttgtttcgttcgtacgtcatggcgaaacacctaatgagtcggtatcaaggcgactcgtttgaagcactatgaatcgactcttttatagatgaatcaacagttttaaacactgtattcttacagatttaagccttagctggatacttcacttcacttagagctgtgttacacactacatggaggggaattttcaaaaacccataatatgggctctttaaccaaacgtctagaatttttaataaataactcaataaagattaaaaataactcaacaaagcaccaattatattttaactcactcatttggttgaataaataacacaacatttttttagagtgtggatgtttcccagtaatgggttgtagctggaagggcatccgctttgtataacatatgctgaataagttggtggttcattccgctgtggcgaccccagattaataaagggaccacctttaggccgcctttgtaacttgaaaaagttattatcacttcacagtctctttctgaaaattcattcccagcatatggaatcactggtaaatcacttttggctggataataataaatagacatttttaagtgtaatgtctattgctgactgatatgccataaatcataaatatttaatatttgcagctatactgactaagtctgggagaaaagaaagaagatgtttaaatcgtttttatttctctgttaaattctctctataacatccatttgttcaatttccaagtattataattatgctgacataatgatgaatttttcaaaccattttacaaagcacaataatagaaacacatttacagaacatgcatcttttcatttactgagtcacgctacacaatatactgtatgtcttgagcacattctgtaatgagctatttggagatcaatgaaacattagtgaatgaagcgctgcacattcatgaacatgttactgaatctttcacatgcggtcactctgtacatcagtagatatcgtgtgttgtgtttccttcctggtttctcttgattttggagcagcagtgaggcgtcctgatgatgttttctgcatcactcctcatgaacacatacaacaaacagtcaaccagcgggtttaacaaataaagtaatatggtgaaatctgccagactcactttagaattatccacattattgtgataaaaaaacataatattaacaggcatagttagaaacgtgtaactcatcagcacaaagaacagaggagccagaactagctgcttctttataggagtgagagatggtgactgagaaagagatctgcatgcacccacaaaacatgcaatgatcactgcgtacaagatgaatgataggaggagcgtgccatatgtcatgatttctgcagccccaaatacaaaatttaaacctggtagaagccaacaggtgagtgaagtacatataagacatttgatggaccgatgagacctgtgccaaataggatgagcgatcataacgtatctttctattgctatgcaggtcataaaataaaaacttgcccaagctacaaaaaacatgatggcaataaaaatggagaacatccaattggaacaaaaggtaaagagtaaggtcgtaacagcttgtatgagatctaaaatgagcagatttatgacaaaaactggtgtggcctgcttagatttgatgagagtgtaaacagcaaaaatagccaaggagagcagtggaatttcaatgcaagagataatgtaaacatagacaatctctccaattaagaaatctgtattaatgtcagtgttgtttgggttggaagagttggaaattttgctctcagctgtgatgttgtgaagatcacttttagatgtcattgttggaggtctttgaggttccttctgtgacaccagtttctccttcacctttgtcttgtaatcttgtctccaatagtcgccagacctgcagtttgacattataaaaacagatagttttgacctaatatatagtgatttaattatacatacatggggcagttgtgcatgggataatgattatagaggtgaacttgaaattccaagataatgaattgaatttttttccatattcaatagccaaaacctgtgctttaagcaatggctgatctgggtgtgtgtgttcccactcctcactaatgaacaataattcatgattttttcaggaaacctattcttaaaggattttcaagaaccaagaagtggttcttctacagaaattattcgcaaacacattcctggagaccactgaaccttttgcttgtctccttcatcaagctgtatctttttggatgtaagcagtaatacagtgctctgttttacagtaaatatcatgtaaacatgctaagtcattaagctataacaaatagttatatataaatgtaactaatctattttgagtccttaaagctcataattaataatgaaaatgggaatgaagtcaaaagttattattattttaaagcatacctgccaacacttctgtttttttatttctcccggaaacctcctgtaattcccccccttcatcaactctttcgtacagtctataaaacccccggatcgctgactttggtatagtattcgatcgaatcggctgcccgaaacccagtgcatagtacagttacttaggtgtgttatttagacacctcactgcgacacctagacatcacccctctcctccctcgatctgccatattttcagagacaaattttggccgggatgttttaaagtaataaattaaattacagataattgcagcctaataataacaaccccgtccagaggttgcagaatataggcattcattaccattctagactaggcttagaagatcaaaaatcaaaacttaaagtgtatcaccgaaaaacgaagtacaagaaaaaaatattaaaaaatgtgatgctgttttaaaattccagcttaaatgtcaagctatgcctaaaatcagtggtacagtttttttattgttgttatttcaagagcaagttagtcatcggctggtgcaaaacacacctacactttggatattacacacacagtagcacagaaatatcatcaaaaattatatattaaaggattaaaatgtacaaaagtattacatgtacctcttctcatgtacgcattcttcccctcaggagattctgatggaatccgactcgttctaaaaattgtctgcttgcacactttaacctcatgcaggagcagatccgttttcttgctactgacacaatcagttgttctgcttacgaagttcgccatgtaaatagtaaatctgccatggcacaactgcaactcgctcaaaaagggaatgggatgagatgagactctgattagttcaatgcacgttacacccaaaacacacccataactcattaagagtgtaaggacagcccttttagaccatgcaccgataacaattttcccttccataaaaaactaaagtggaattgtgcaccacaaaaatcacaaaaaacccatgcaaacaagtaaatatttaatttaaaaaatggaaaataataaatcatttgatattgattataacatagtaataaaacgtataaaacataaatcaaatttacagaagtaaaaatctattaaaatgaaaaaaaaatctgcaaatgtagtgaatctcatcgaaacattcaggacaactacagtacctgctttctacaaatttcagtcttttaataatcacataatgctgtgttatggttagcatatattttgattaatgtgcaacctcatttaatctattttaaaccattttttaggaaacttttaaagaaaattcaccattcacatttattttctttgctgcgagtgaccagtctgttaactttaatcatcagctagttgaagttgacataaaaaaaatacacattatacagtaatttaaaattcaaacataaaaatttctcgacaaagcggttcattatttttaaataagtctttttagctgtccaaagaaacctggtcctacccttacttgtctttatcctgatgatgtgctatagtgttgaccaaaaaccttgttttctgatgataactaatcaacacatgatgaaggtttctctctgactcgagacgtgtttagtaaagcctttttgtccatttttaaccacaaatttgctgccacagttattggcactcctttacccattaggtaattggtatgaaatggaaatcaaagtgctttattgccaatccctttttaaaactccttccttttcccataatttatataatgatcttgttaataatttaaaaaagagctactgtgcatgtacaatgtcatacatggggcggttatgtactaatggttagagagttgaacttgtaatctaaagagactgaaggtgagggaagtcaatgatcagagctttcatctaccttcaataaccacaactgagatcctagaagcaatggctgctcattgctcagtgtgtatgtgtgcgtgcgtgcatgcgtgcgtgtgtataatatgtggttgtaaaaagttgtataatggcatacagttggtaggacttagttgtactttgtgaagatggtttacggagacacacctcatgtttctctaatttaaaatgcttaaaaaacatatttaataaagtgttttgatatatatatatatatattttagaattatttttaaggggtttttcacctttatttggaaaggacagtagtggttgcagacaggaaagcattgagagcagagaggggggaagggttggcaaaggacctagagccagcaatcgaactcgggtcgccgtgagcaccgtggtgctatactgtatgtcagcgcacttaaccactaggctattttcaagtgttttgataattacatttggccacatgtttcctgtgagtgttgggtttaggggtagggccataccttaagcatgtttactgtataaaatacatgatgcctaattgctgtaaatatgcatactgttctattattttccagacaaccatttccatagagatcaaatatcagaccatggacgggagtgtaaaggtgtggagcgatggtgaattccttgatattccagatgaccttgatggaaccttccagtttgagacagatagtcttctctcaggacgcagccagagttctggaacttcacctggacgatccattcatggcattcccacattccgcaagtgagtcagccatcactgctaatataatcaccctcatcatcttcatcctctacaggcaacggattgtaagataaaactgggattagaaggcagatgaagaagttaatgagggttaaatgaaggctttattttccattttatgtagctatatggaccacagtgttgcataaacatatatagaagtgtacatatataatcatattattacttcattttatttttgtattttagcacattttttaaactgtaaacacatttttgctgaataacatgaaggcgtagattacttgaatgtgtgggatgtattgatttccactaagcctaccactcttcacatggccccagatccataaattatagccatatgcagacacaacactgtttcttccttatttgtgtgttggcatcattagtgttttttatttttttattttttttgtgagtgtttacatatagtgttgatgaatatctgtgattactaatgatattaagggagttgttaaaagttactggtaaattagagccaaatcatttattgcttttcatttaggattttgaaagctgcactccatttatatttagtatttaatgttgataataaattagtacttggtcaaccaataaatcagatatattaaaaacaaatagtgaacaaatttgcaatctttaccaagagattgatgaatactgttgtttttttatctacagtatgtgttaaatatgacatgtttattaaaacacaatagtaatgtattgtgacatgctagtatgtgctggcaaaatcatcaccttggaattataaggttctctctgcgttctgaaagactttgagatattgagcttcaaagtttttgcattccgtagcaaacagtatgtgtttaacatttgttttttaaataaaaagtcttaaactgtaaaagaaaaaacatcccataatgtaaagaagttgtcatttaatatgaatatgtcaataactcaattttgacaaaaatgtcagatagaaccttagaattcgaaggtgacgacatgttaaaatatgcttacagcattttaaaatcgccactgtaaccctggcataataaaacacactagcaaactagcatctgcattgtgcaaagattcagtaaaggtctttgagtttgtgttttttatcaacataatcataataatcataaatatcttaaagggacagtatgtaagtttgacaccccccagtgcttgaactagcattgcattactgtatcaaaatacatgcaagcgcaggttgccagattgatgggagtgtgcctgactattgagcctaaaggctgatataaggatttgaaccattttccaactaaaagcaacggtatacaatagaagacatttttttaactaaaaggagtttttgtccgaaccattacctaaaatttagattttagaaacggcttctatttcttacaggtaaacaacaggatgaccctcaggtacacctcatgtgctttattcagtgttaaatgctaataatgtgagttttaatgtcattttacatgacatttattgccatactattgaaaacagcaaaagatagtttacctcagatcttgaaaataaaataaaccgttgaactttagaaacgtaatctcagtgcaagccaagttaataaatatcactcattcagcatctccgtttaataatgttatagaggtttaatatgtaccgattagatgataaatcttgcagtttcatgagtaagtgcatattctgtgcttccaaatggctatatttaaattttctattatgttttatttggtgcaagcagccaaatttcttatcactgcaaatcccgtcatgtagcgtgttgttaggacatggggttgtatgtgatgtaacaacaacatggccatgttggacaatgtagcctgctcacctaatgtttatgttcataatatttataatatttgctaattaataaccacctcttgtggatctctgattctgctactgtccaccggaggtcgcatttttggtcacagacacatgctttaagagccttcctaactgatgttcctaacttcctacgctgttttacctgaaggtaacccaaggcgctgaattaaaattggctaaagtcgcagtgtgtgggttaaaagaaacaaagcaaacacaccgttttggcacataacagaaattttcaaagcaaaataactgactttagcattgtttttcagataaacaagaatgttcacttagcatgtttcataagtatggtatttctatgctttaaaagagtaaaaaacttacatacagcacctttaaagaaatatttgacttctgcatacacacgtattgctaatgagaaacactgtaaaaaaatataacccaaaatcatttagacatttatatgatgttcaattcaatacaattcaattcacctttatttgtatagcgcttttaaaatgtgcatagtgtcaaagcagcttcacataaaagattatagtaaattggaacagtgtagttcagttcttggagtttaagttcagttcagtttagttcagttcagtgtggtttaataatgactactgagagtccaaacactgaagagcaaatccattgatgcgtagctctaccgatcccgaaccatgcaagccattggcgacagcggtgaggaaaaaaaacttcaccaattggcaaaagtgaagaaaaaaaaccttgagagaaaccagactcagttgggcatgaccatttccatttctccactggccaaacgttttgtgcagagctgcagtctcagcggctcacctcgtttgtccctggagcgtcacaggaatcagtacatgaatgatgtacatgaaatattagcacatttgtaactcttgggatatcctaccctacgaatttccagaagtttaagaccatttgagagcatattactgatcatccgttatttgtaattttaatgttttcattgatttagttctgtcatgagatcaagtgcagagaaaaatcatatttatatgctattctgttgtttttggatatgcagttatttatcttcatgcatagaaaattcttgtcagagagttattatcaaaacattttagcacatttttaaattgcattaactaactgatatggtaagagtgtatgagaacagacaaagggaggagacgagaaaatgaattcttcaggtatgattaaattgtatgtgtttattatgtactgcatatactagttggcataaatgtcagttgcctagtcagacaaacacaccaaaaagtgaatgtccaagcgatggatttggggtttctgttatacatctttcccattgctgaccagaagtgagcacgaagtcagtgtctttgatgctttattgatgacttctgagctcacgctgaggtttgctatacatcttcaaaaacttgaagacatactgggagtaggactatgctttgtattcgtcttagttctgaactgaatgcaattttagtagttcaagtagtttggtaatacagcaatcggcatcttgaaccatttgaagattattattgattacaaaaatgtgtattatatttatatttggaaatatttgacaatctagaccatgaacaattgtaaaacatttgagacaatttaggttgtctcctttttgcatttataatagtctcctcactattgttacttgaccttcgttcctttttttcattattgtttcattattttactgtgtgtgtgtgtgtgtgtgtgtgtgtgtgtgtgcttgcgtgcgtgcgtgtgtgcgtgcgttcgtgtgtttgttgtacagctgaagttgttgtaccccagtgggacactgcaaatttttagatctaaagtaactgcaagtcctctctaatgactagacggttctctcatcttcacccctctcgctcctccagctttatctctgtctaacatttctctcattcacgctagcttctttccctaaagagtctgcagctacttgaacttgtgctttacattctcaaaaattctgtaacaacccagtgtccatgtgcagtttctgaaaaaaaggtgcatgtccaatataaatgaataaacagatattgacaaggactgctcaatcagtcgattcatcttataaaagatcctatgaccaacttctcagttattgaaatctcagtttagttttttagactttgttttgtttatcttttgattttatttatggtcatcgttctaggctataaaaggtcagagatctaagtaggatgtgtattgtcaaaatccaggtgaatctttactgtttccagcaacagaaaattatgtattggacgtgacttagacgttgacttactgtataaggctagattgaaatggctgtgatgggtttgcacttcgatgttcttactgcaatcagtccatttgaagatcttttgattaagtccctcaatgggactggtcaatttctacctgccttataagtaaaactttattgtcatgtaaagaattatgtatctttaccattataattacatgaagtgctttcatgtttgagtaaaatatggttaattttttcattttttaaaaatctgatcagtttttttatgcctgacccatctatttagtcgtttagctgacactttttctttcaaagtgatttacaattgaggagggcattcagtgattcaccaagaagaggcaatacacacaaatagtgcttattatgcaaaggaacagtttatgctcagaaaattaagtgctagagtaaggagggggagtgtttttatagagagaagaatattactacggatggtttgtcaagcccactcagttgtataaagcacacttcataatgcagttctttttagaaagatggagtaattgtaagaaaatgtctggtgcaaatgtgcttaaactggcgcaattgtcggttaaagtgtcagaaaggtttttttattcctctttgttttggttgttttaagctttgtttagccttttttcacattttttaggggaagtctgcattgcgagatagaagcattgttgatttaataaacagaaattgaattttaagctaaaattttattaaatttacaaatatggaaataagcatttcttaacattctaagtctgtatctcacaattcatatttttttcacatctgaacaattcctactttattcccagaatcatgactgcattttacaattcagactttacaattcctcaaaattctgtttacaatcccaagtattttttccacagaattgtttatattattttaaaatttcccattaattgtattttagtaacatctacccctttcccaaccctaaacccaaccttcacaacaatgtacaacagatctggatctggagtcttctcttttaggcaccgtttacactagtgcgttttagttttaaaatggcgttttagaatgaaaacgatctgcgtccgcacttgcgttttacccagcgtttctgaacagctctccgtccgcaccaaaatgctgaaaacgcacatcacgtgacaacacacacactctcaggcaagcgctgcaacctatctacccagatcagagctctgctagtcggactgctcatcaagcatctcccgctggatctaatctcactatatttattaaacgtgatatttcattcatcttgttgtctttatctaacgacatgttccctgactttggtcattggaatcaattacttgttctcaggtaacgtgttttggctgagcgcaaagataagttaatgattattgtaaccacgtagcctacattctgtatattgactgatcgcttgcctttattattatattataaacttattgtatgttatacttttacattatcaattattaaaacagatattcagcaaaagagagggtatgctttttattttcaatgaaattgaaaggaggcagttgttataggctccgttttgttataaatatccacacagtgaagatgacgctcataaatgcagcacaacgcctcaacattgcattttattgttgagaaagtgaaacaacgtagccagggtgatgtgaatgaagttataaagtacactgttccctttgaagatttacccgtgtcctcggtagtctgttttccatatcaaactgagaagggggagactgcagccttgatcaaacttgcgaagtctgaacttacaagaagaggactgcaggactgaactgtgcgtgttaggctacttaatattaagcaaatgccccaatcaaatagacgaatgtctgcagccccgcctctgttttcagatgtctccgttttccctcatccacactgtgatgaagcagcagcgttttagaatgaaaacggccttaccagcgttttcaaaacgctccgtttttcggcactcgaaaactccagcgtagtgtggacggatggcgtaaccatagcaaaacgtatgtgttttaaaacgaaaacgcattagtgatatcaggccttagtatagcgaatttaccatgtaaatggatgattagagccttctcagccaaccaataggtgcagaaggcccctactgagccatatctataagctgataaccactgataaagcccattcaatcgactgataaaaattgaagcgggtaattctatgtttacttcttaatagtttacaaattctcagaattcctgttttcttcagttctgttttcccttcataattctgaatttacatgtatacagtagtcaacatttgaagtggatctaaaatgttttttaaaaatgtcataagacatgagtggatgttgtttaatagttttaggagaactttgatgaaaggttttgaactgcttcaaatatttagactgtttcacagtgctgcctttttgtcacaattctgccaagatctaagcttgaagaccagctaatctggttcaaaccatctattctcaggctggtttaagctgtcacaattgccacttctgatcagttttactatcataacttgttatttcttaggtaagcctaatcagaagtgttgttctcctgagtttttctcaatgacaggcctaagcttgcagtcaaataaccttaaacagaacaaagggattttcccagggatgtttgtcacattagagtcgctgcattactctcgtggttcagtttgctgtctttgttgtactctaatgttcagcctccatcccaccattcttttgttcttctctcctccttcttgcataaaactgtcactttgaacccacacacactttaaaatctagggcacaaaagctcaaaggcactcattgttcaataattcatgactttaatagagtctcacattaacgaaacagaattgtgctcctttttcattcatgcaataatgaaaaaggagaaaaaaagaccaaaaataacaacaagactatgaaagcaagtacttacagtaagtatagtaatgtctctgctgaacagggtttaaagtgtctagtttataacagctgattgatatttaccatttaaagtatcccgtagagagaaagtaatttataaatagcaagctaatgtactgtacgttactcataactgtgttctgatcaatgatttgatggaaacaaacggctttgctttagttcaggtttttggccaaactcatctcagacatcaaggtctcgctggctcttaagtgatacataattcattatgctgcgttgggcttttcaacacattcacttctgcctagatgtattgctgtgtgtatatctcttgtcatgttttagaaatggaggatgataaacagtttttaaactgactttacgttgacctgaatgattttcaaaattcagtgaggtttatgtgtttagttttaacacatataaaatatagaatatttagaatgaattacaggatcaaaatacaatagttcaagtgatggtagttgagaaattgagaaaatatgaatacttttatttaacaaaggtgcctaaaattggtcaaaattgtgacagtaaggcaattatactgtttagaattgtcaaaacttttcattcgatgtaataacaaataatgttcagtttcttgcacagatctactgtatcatttgcttttataacagcttacagaaattaaggcatggatattcattttgttttgccagtgttttacttttttttttttttactctcaaagagctggtagccattgattttatgaatcaccaaggagaacagtttcaaccagaaatcaactttaccattttatttaataaaaataaattaaattaattaaatgaaatttttataaattaaatttttaaaaaaattaaataaaataagtaaactaaattaaattaaattaaattaaattaatataaaatgcacccacagtacagtaaatggtcttgcagatggattgttttgggtcttttaactttaattattaaaaatgtttctgaatcgccagatcttgatattagaatgattattagatactgtggtactgaagagtgtagtaatggttgatgatctttccgtttgtcataacagaaataaatatcttttttgttgttgtgaataatcaagtttaattgtgttaaattgtaataatattttattatgtaataatatattaattataaatgtaatttgtatttcttttttttactgtatgatgaatactttggcccttggtaaacaaaagagacttaaacaaaaaacatttacaagtagtgcatattcaaacttgcgatgtttttgaattctaatccacattcaatcatttaaatacatttacgtatgctcataatgcatcacatcttaattcctgaagcaaatacaaaatgaatggtctttcacatctctctcccaggtgtcatgttctctcctttcattttgagttgacagttgttgtgctatctgtattatgttactggttctaattcttaaacggggtttagaaataactggtttgtgatcagtgactttatgtgcaccatggattagcttctctactcataaaaaaattaaatgtcactagatctcacccccgcacattaaataacatgaaaaggtcactcttcagtaggagaagagggattacatgctttattaacatgagagtttggttctgcaaaggtttcaaattcttaataaaatttaatataaatgtatgatgtatgtctatttatatactcaaattaatttttgtagtaaacgaaaacaaagactaaaactattagtcaaaaaacattttctttaactgagatagaattaaaattgcacaataaattaaaaacaaaacaacaaacagtcacagaaacatattttctatataaacataaaggtgtcccagctgggtcagttgacatttctgtgttgagtttgcatgttctccccgtgttggtgcggatttcctccgggtgctcagtttttccccacagtccaaagacatgcactaaggctgaattgaataaactaaattggccgcagtgtatgagagaatgagtgtgcatggatgtttcccagtactgggttgcagctagaagggcatctgctgtataaaacacatgctggataagttggcggttcatttcgctgtggcgacccttaatgaataaagggactaagtcaaaggaaaataaatgaatgaatgaatgaatgaatgaatgaatgaatgaatgaatgaatgaatgaatgaaggtaaatatataaacattaaataaagtgttcacataaaaaaaactaaaactaacaaaactatcaatgacaccaactaaagctgaactgaaatgaacagaaatgtttaaaacagcatcaatataaaaactaataaaaatgtaaagctacaataaccttcactcaagtagaacatttgaaatttaatggtaaaattaaatattatttatttatcacaagtatttcaatgagtacgtttacatggacaccaataatacaattttaatgcgattaagacaatacttttagagtctaccatgtatacagggatttttaattaatttaatctgattaaggtcataatcagactaaacagaaatcaaattaagacatgtggagtttgctgagtttgtacagtgcagtagagacctgtaaacaccttaatcaagctattattgtcatgtaggattttcaccacgatttgcgacaggatagtctatacacacacgactgtttgacactattctctgcacctactgagtcagtgaagtaccacagacacctgcatcgtgaaatgctgagatttttttccccatactgcttgaggtttcaaattccattaaaacaacactcttccagcagttcatactcgcaatcaatatctcgtttgtgacaggggggcttgcatgaaatgtttctgaatgaaagtgaaagtgccaaactgcagttaagaagttaaacaaaattagaactaaaaatgaaactcctaaaattacatgaaaatccggaggaaatttggattgcgtcgtgatgcaataatgttaattgaattatgtgctataacatgtaaaattacattatagcacatagggattatgaaaggaactttcaaaaagcaactcatgtaaacaccttaatcataatgttcagattaaggaaaataatacaattactgatgtccatatagtcattgactgatattgtacccaaatgtctttcttgaaggcataaaaaaatgtgcaactgatgcaatctaaaactcctgctttcttctctattctaaagcaatgtgtaggtcaaacagacactttcttatacagtatagtgctgaaagtttaccatacatgtgtgaagtcaaacctactgcaaaactatttcatgtggcacagaattagttccaataaatcccatagacctggcaaaggacattgtttgcactgtcaggtggtgcctgtgggtcgcttgtttcttcatgaccgctgaagtggatcttttgattaaacagagctgctctcatcacgctctaaaaatcatctaattagtgttgggttaccttgtctagatacaatcctgcatctttcttgattttcttttgaattaatctttgatagagtcaaagagaaagtctgaacataaagtttttatgtaatttttatttttggtgatagagtatgttcgaacatacagttttagtcagaatttagcccctttgatttttttttctttttaaatctttctcaaatgatgtttaacagattcaggcaattttcacagtatgtctgataatattttttgttctggagaaagtcttatttgttttatttcggctggaataaaagcagtttttaataaaaaagataataataaaaagcattttaaggtcaaaattattagccccttaaagcaaaatttttttttcaacagaacaaaccagttgtacattgttatacaatgacttgcctaattaccctaacctgcctagttaacctactgtaattaacctagttaagtctttaaatgtcacttgtatagaagtgtcttgaaaaatatctagttaaatattatttactgtcatcatggcaaagatcaaataaatcatattagaaatgagttaaaaaaaactttcatgtttagaaatgtgttaaaaaaatattttttccgttaaacagaaattaaaataataataataaacaggtggctaataattaaggggggctaataattctgacttcaactgtatgttatttttacattaattacagttattacagttagtttatctgataaatgaaaacacacaggacatttgtaattgctacaacgcacaatacttatgtattattatatacagaatgcttcaaaatgattaaggtctcataactattattctgaagtttaaatgttcttatggtggacatctttctttttttctgttttgcagaatgccaggttttgattttgttatgatcaaaaagtgttattctatcaaacattgctttcttaacattgctgaagtttatagattgatattttggtatttagattggtaaaataaagtggtatttatttaatcttttttaaaattaaaccaatataataatcaccattgaaaatatgaatagatcataaatccagagaaactgctataatttacaatagtaaccacagcaaattttgtattattataatattttacatttatttgatacaatatttaatagaatgtttggtaacactttattttaatggttcttttgagtattagtagactgtctgcttaatatctgttgatgctggtcctttaactgactataagaaactttgcaagtacacgtcaacttacactaaccttaacccttaccccaactctaacctcaactgaacagtctacttactgtaaaatctaatgagaattagttgacatgtaaatgcaatataacttaaattcaacacacgaaccatcaaaataaagtgtaactgaatgtttttttattttgattaatgcatcactgctaaaaaagtatttttaatttattctgaatgtatatttagatttacacaacagtaattttatatgggccacatctgtgagatagtgagagtgaatgtgtgggggagtgtgagtttgtattggtgtgtgtgtgagtgtgaggtcacattctctcctgttactttttcacctataccgggccatcatctcaggttctcccttattgtggatgttccgtttagtctgagaagtgtctctttagctgtgtggattctgtgcttgaatctggactagctggactagccactgaaaatggacatatagtacacactctagccaggaatatctatttttatacacattttctgtcgggggatttttggttgtttctgttttggtgagtatcctatgttatttgtgtatctatgaaagcatatgtgtatatgacgtgtatcaggattgttttatttgcgatgctttttgtctttctttgcatagcagagtcagatatttgttttctgctgtggatttcatatacataaacttaacacacttctttttttattttttttaataaaaatgcatacagtcacttagtttcataaacgaaaataaagtaataataatacacaaatgtgatttgataaacttgtgcgctttttacttaagagtaacaaaatagcttttttgtttggaaaaaaaaacgcgtattatcgttatttatttctattaatggataaaatcgtgtgaactttgaagactttctcttcactgtcactttaagttgtttacaaagattcaataagacagactgcatcagatatgcctccatcatataagaatgagctgcaaataataactaaactgcagaatatccaggcaatgtaacctgtaaatgtatgtaattaatccaaacactggtgaagtcagtgtgatcctgttgcattttccctccacttaaagtgctgaaaggaaagaaaggaacaaaacgatctggatttctttcatctagtcctgagaaagtatctatatccacagatcacagctaattggcgaattgtgcccatcttgttgaataattaagtgccgttatttgtccagccggcctgtgacatcatcaggcctttgtgggggaactgatatctaatcaccataatatcagtgcagagttattggacaccagcggggctattgtgagtggggtcccgctgttgaaacgactgtctcgtctgagtgataaatatcacagaaattttccatcatcatgctccagtagtgatgatctgattgcactcaaactttacaaatgataaaataaacttaaactgtatgtacagtgctcagtataagtacaccttatttatacaccttatttgttttttaaacaaaacagatttattaaacagatatttattaaaataatattttagtcaccaaacatatttagagactgagagataatacaattaaattcaagcaaaatattgtaaaaaaaaaaaattacaacctacaaaatttaaactaaattattattattattattattattttgtctcttttgatttctttctcttttataaaatttatatttaatatttttctataacacatacattttggtgtattagtttctgaaccatatttgtcctcagtactgactgatctaatgtatatgcacagatataatattgcatagcttatgaatgtaaaaatctgaatttaagaaagagatttgtgaggggtggacttatgaatgctgagcactttatgtactgtaaaatgtgtttgtatacctggatatcttttaagaaatatctatgtgtcaaagaaaagtgaagttataaatcaatttctcttttctcatgcatccacacataaaaatgcatcatgcgtatcaggctttttattgatttattgacttgtgcaatgtgtgtcatcatttttttctgttttgtaatagacctaaatccatttctctttatttcatgttctcttgaaaatcttctcctgatgtaaacacattcatttgctaaatagactgcagttttgactaagaatattttaatgtgttgcttaactgatcttgactcatttataaaagctcagaaaacattctcgttattgtcagattatcagaaaaagtcaaggaaaaagattgtagaagatatcctatgcttgcatcatgaggcagaggtgtaaataatgactaaattgcaacacaatgtttgaaaattgggggaaagtatctgtccatggcacaacatacaagtgagctgtatgcgttaataatttatatgattaaattgtggaatgtatccaaatgcatcactgcttttaatacaatatgtatgaaacataatcatatttcttagtttaaactggtataaattattcagtgttagggaggctcggaggtagaggtgatttaaaaaggaatcgcagagcaaatattgatttccccctccgttcgtgcttgtttgtgtgttgtgttgtagggcaggaaaaggagtgttctcagccatgaagctgggcaagacccgcacctctaaagatgaccacaaaaaaggaggtaaatattgatcatcattagaacacttgtggaagatgaaagtctaatgtacagtatgtttattgaacaaaattgcgagagtttgaagagtttaaaagacccacccctcaatgacaaaggtctagaatttgtcccatacatgagctcatttgtcctattttgactgttacaccatcataaattgtgaaaataacccattgaaaaaggctttaagaccaagcggaatcctctgtcgatcgtcacatcagtgtgacttcagctaatcagttctggccaatgcaaactattatttttcatgagtccaacatccagctgtgcaataaaacatacaatatgtaagtgaagttatttttcgctattgtattatttttaaatagagaaaacattttgctagtaaattttggaccttattcttgataacaaaaacaaatgaccaataaaaaagcgtgaagcacccaatttggaccatattaaaatgaatttgaatactaatttagcaatttttgttgttatccatgttttttctataaaatgtactttttcttaacaagagaggctagaaaattgtattaaattggcaaaaaaataaaataataataatcattagcagctattaagtataagtatttgtgtctccatttttaatcattatatgacattcattcattgatattcactggttttgatttgttggtattttactttagacatcaattgtaaagactgaagaatcataaactgcacattagacatgaaactttaaaaggaacagaagttgattgcatattataaatatatattttataaaagaaatggagcctgttcctttcaaagtttcacttctgtgctcttgtgtgcagatgatgctgccattctggatgcagaagatctggatcgaaaagccatgcgtctaggcggcattcttgaccctgatacaatctcactggcctcggttactgcagtgaccactaatgtctccaacaaaaggtcacatgtctaatgtgcacatgctgtatttttaaacccatacacgtacactattctattttgaagtttgtatgtttgcttcttgaagtttatatgtttgtgaaaaggtcacagggaagaaaaacctcctatttatgtctttctttctttctttctttctttctttctttctttcttcctttctaaaattaaagaaagaacagtttgctttgtttctgatgttgtttcattgacttttgtttttcatgtaattagtttgataaaaatacctaatcaaggtctagttgacatgtttgattttccatattttattgtgtgctcgacataatacatgcaaaatttgatttaaaacaactaatcgtttaaatttgtgtccttaaggttgatcctcttgtttttccagatcaaagcctgacattaaaatggagccgagttcagggcgtccggttgattatcaggtaggaacagagaaacgattaaacagagagaaaagggagctcgataacattccctcagacaaaagcttcgcagcctcgaattgccaaggagacatgttaagccagtggcatttatccttgagtagtgtattctgctcaaagccttgaaacacagagccgtcccaaataaacaacatgagccttgagcgtcagtgttttagagaggctttgatgtttgcttactaattgtcctctgcatgccagttgaattgcaaattcgcttcagtcctggcactgcataattcctttaaatgctggaaatccatacagaacatcccctgtgtgctgcgtaagtgttttttaggccatttttcacattattcccttatctctaatagttcatattttgccagaggttgggaactctgcttttctgtctttctcttacttttacaactcatttgctgaaagaataattgcagactgcaattctaagcgttattattatctgtgtttttctgaagattctatgaagcaaagtttatttgcatttgtctcttagtattgtagctttggagtgcaataaaggtggcacaatgtggtgaacatattagagacattgcaatttgtgcaacgcaagctcattgtggatacgtacccctgtctacatttctggagactgcaaattatgtacccagaggtatgtctagctccatttcgttcgtaaaatgaatgctatgggctagtatgagatcgccattagctctgttcctcttcatgctactgttaaccgcttacctctgtgtggacagcttttctggtgtcatcagttggcccagtagcttgttgtgtaaaccgatttcctgacagcaggtaaaagaaaagaaaaatataataaaaacaggctgaaaacatagagaaatcagctgcaatgcttttctttttctagattgccttttgaaaacactattggttgggtttagggaagtggttgggatggtttgtcagtcagtcagttgacagcaagctggcctggggtctcatgtatcaacgtttggatttactaacgatgaactgaacgtgggaatgtgcgcagctccacggcagctttatggctggcatacgcacattttttgtgagtgtctgttttatttccattggcgactcctagaggcagttgtgttaaattgctctctacaaagtgtctgagccttgctctagcagctatatgagacgggttcatctagcaggtatataaggtttccataccgtaccgttgaccagctaaacattaaagcacaatttgcagcggtcgcctgttttcccaatgtaatctgagctatctactgcacgcacattgctataaagacactatctgaagatgaattttcatgcgtgaatcagaaacatttccattcaatgaatgtgcaaataaaatatgatgcacaaacttattattgaatcctacttgtatttctcgtgataaatagttggcaaaatctgatatgatgctggattcgaaccgagttcatgctcaaacgtgtcaaaacatgttgaaatgcatcttacgagctgcgccactgagactgttacggatgcagcaacattttacacccataaatcacaccatttcttttttaattcactcagtgcgatgttcagacccaattgtgttaaccgcatcagctaaactctccccattctatttttttcttttgctgttaattccggagaacaaacttgcaaataacaccgttttcctccggtctacctccgaaagcagcacctccaattcacattctgttcaaagtttctctttttgcttgattttgtcattgctttttcgttgggttttgccaaagtagagtcattagcatattcatacgggggaggaggcaggaagggggttttgtgctcgtgcatgttgcgctcagtttcacgttcgttcggatgtacaaaagaatatgcgtgagattcagcatacgcagtgtttcatacatctgaatttttttctgcataagcacaaagctgtaaatgttttagtatgatttccatgcaagtcttcgtacatgaggcccctggtctgctgaagtgtatgttgtgccctctggtggatttacgtgagaagaggacacgtgacagagaccatcaaaaagtgtaaagagtggcttctggcggatttgcataagcaaaaactgcacgcagatatacttgcagttacgtatttcactgtcctcagaaatgtagacctgggtatgtatccgcaatgagcctgggtttcatttggtagttcattttagctgtgtaaatctgaattatcttggctcacttgcgagctgaaaggatgaaaagtgttatgcttttctttccattgactaagtttggtttggtaatttgtctatatgcagccttggatatttactttatgaatctgtgatccagtaggatacgctggagctcatttgtcatttaaatccccaaagcaaacttaactaatttgctctctgtagtaataaatgcataacagatttcacccccaaatgaacacagcctcatcagtcttagtcaaagacgcccactgtaggttttatcagcagtattatttagttgaattgtgatgtcttgcagatcagtgttacagtaatcgaggcccgtcagctggtcggattgaacatggaccctgtggtttgcgtggaaattggagaggagaagaagtacacgtcaatgaaggagtcaacaaactgcccttactacaatgaggtgatgacattcacagtgatgaaacgtctgagcagataataaaacaaagaatataaaaaatatttttcatgttattttatttaggctttttaatcatatttaaaaaaatggaattaatagtgataaattcaaaaagccacaatggatttctgattcaacatatgataatgtaaaggggacttataataaataaataacttgtctaaatatagcccgcctctaatggtaaaacttaatcaagtacattttttataaacctacctaaatcctacagattagcgacgatcaccctattattatcatataaagtatctgtcaaagatattgtcagtgactaagaatcattatgaatgtggggctttaggatgcccaaatgaacagtgtagtctccatacactaccttttttaagccactgtttttgacattttcagtttttcacaaagctaatgctagtgctattttaaatccatgcataggcatttgtagcctgccctcatttgaatttaaagtgacagtcaccaaaatgacacaatttggatcaaagcctaaaagaggctgtttaaaatagttctaaaacatttttgttgggtattttgagctaaaactttacatacacagggacattagagacttattttaccacaataggtcccctttaaatgtttggttggaaaaggatctgtctgtttactaacaggtttaatgcatgttggattagaaatgcacacagtaaaaatgtctgataattaacagttgtccataattcatgtgggtgttttctgtttatttacttttcaattgcattatgggacacgttgctttgagagcttttaaaagtaatttttattgacacatttagtggtttaaagaatatgttgtataagggcgacgtggtggcgctgtaggtagtcacagcaagaaggtcgctagttctagcctcagctgggtcagttggcgtttctgtgtggagtttgcatgttctccacgcgttcgcatgggtttcctccgggtgctccggtttaccctacagtccaaagacatgcggtacaggtgaattgggtaggctaaattgtctgaagtgtatgtgtgtgaataagtgtatggatgtttcccagagatgggttgcggctggaagggcatccgctgcgtaaaacatgtgctggataagttggtggttcattccgcagtggcgaactcggaataataaagggactaagccaaaaataaaataaatgaatgaatgtgtttttaagaaaaattgtacagacaagtcaatttgaatgcaataataacagaaatacttgcagataagtacttggttttgcatagtaatttacaccacttagacagaattttaaactactgttccaaaaatatcaaagcttatgaaagtttaaataaatggaaacacactttaatcagaaactatattttttatttgcttgtttattttacagggacaatacacttggcattgttatacagtacaaagataaccggtgttgcgtacatatagcataaagctaattcacagcccttgtccctgacctcgtccctgaccctaaataacagaacttttagaaagcaagaataattgacttttacttggctgttaagtttcaatggagctgctgtgttgaaaactaaataacacttcaatttagtgctgcgtgactttgacaaagtatgacttttattagctggtttgtttgctgcttttttgctgagtgtgtttttatgccagtaccttttcctacagtatttacgcctgtcagagataaataattatgaagctatgagtgattcaatgtattattcattcaatcgatttctttcaaatgtctgattcattaagaaacgtagtaagtgggtgtcttcatgaatagatcattgaatcattaataaaaagcaaatgacttgattgaacacgcaagtgtttttctaagagagacatatgttttgctcatgctgttggatggatctgttttcattgaccaaccattaaaaaaaaaaaaacaataagttgtctaacatgtaaataatttaaaattccctttttattgtgtaaaatccatattacatagtcatgttctaatgccaataatcgttaaagcgacacttgcttttaaaatataatttaattatcttataaaaacattaatggttatttttcatttcttaatttgaaatgtacattttgcattatgacaactttctaagtgaagtttataaactaatttcgggaggatcgcatgcttatgattgatcacagctggtcccgcataagcttacgattgattaacagatgattcctgactcacttataaataaccagagttttcttatctcagagtcttcatcttgataatttctgtgcggagtttgctttctcccgtgctcacgtgggttttccataggttctctgatttcctcccacagtccatagccaagctcttagcaagtgtacatctcttcttagccattttattagcccaaaataagtcaggaaggtctttgagaacttccttagctcaaattctcctctcgccctgcaaacacgagggagtcccgggctcaaggatctaatgagctcagggctctctcctgggacagcatgccaaataagatttattatcactcatcagctaagtgtgaactcttaaaaaagttttatttcataatgaacactttttttagtcttcttacttgttttacttgttttttttatttttactaagcagtgacatgcattataatgccagatcctacattaaatattagattgtcgtaggtgataaacattgcacacccacgtacagcagatgatgaacagtctcattaatttcatgtctacagccattttgattatctttatctctctctcttcaaacagtattttgtcttcgacttccacgtgcctccagacgtcatgtttgacaaaattataaagatttcagtgagtagataaagccacgcatcatacacttttacaaacctttaatcaaacctccattggaaacagcggattaagttgtacttttttttttgctaaaattaaggtaatacattctaaaaaccttctgcgaagcggcaccctcgtgggcaccttcaaactagacgtggggactgtttacacacaacctggtcggtaaccataaaaataagtgagagatgtactgattaaatgggaagatggcttttatttgttgaatgtttctcacagaacatcagtttcatcacaaatgggcgatgctgtcagaccctgatgacatcacgactggctgcaaaggttatgttaaatgtgacatcgcagtcgtgggaaaaggagacaacatcaagactccacacaaggccagtgaagcagacgaggatgacatagaggggttagtgtgctgtgttctaatcatgtgataataaattgtgccatactgtagcaccaattttggattggtgccagatttggaaggcttgtgcatatttgttaattcagtcattaattaatttattagtacatttgaaggtatttgatattattagatgttaacaaacatagtgttttgcctgattaattcattcatttgtttgtttgttcaataattcattcatccatgcttacaatagtcaatcaatcaatcaatcaatcaatcaatcaatcaatcattcacttactcttacatttaatcattaattcattcttatacattgattcatacatttatttatttattagttcttaccattttattctttttttacatttaattgctttttattctaacatttatttgtttattcaattttgaatgtatttatttattcattcattcttacaaaattcattcttaaaaaagaaacgtagacttgtcatagcatttatgaaactctctgatgattaattcattcatacagtcacctcttttttcatgcatttatcccttaagtcattcgttttatttattatatatttaagtgtcatgtcggtctattctcatgtttgatgatttattgcaggaatcttctcttgccggagggtgttccatcagagagacagtgggctcggttttatgttaagatttatagagctgagggtctgcctaaaatgaacaccagtatcatggccaacgtgaagaaagcctttattggggaaaacagggaccttgtggacccttacgtcctggtgcaatttgcagggcaaaaggtaagaaaccactaaaacatttaacaaggggtcattatttatatcaaacatttttttaattagacagtagcaaaacacttttttggcctgaagtgtattttcaaaatccaaaatacacatttaattgtttattctttactttatttatttataattttaaaaattctaaatctatattctcaagatgagtatttttactttaaaacatcagtttaccggaacttttatactgtacaccaaaatctaattttattcataaatacattctgtcgatttttaccgagggatatgtttatgcataatttgtctgattatatacataacaaatgtagggaaaaaaaggaaaacaagaattttgaacttgtgaatatgtgttcatattcaattaaatagaaaatttgttatgaagcaaactaataatcaatactgtgattaatacttccttgaagatttattaaatgtaaggttttggtctcctgaccttcaccagacatgtacagttgaagtcagaattattagcccccctgtttattgttttccctgatttcttgttaacggagagtagatttcttcaacacatttatttttaccacgatttattttatctttgccatgatgacagcaaataatatttctctagatgtttttgaagacacttctatacagcttaaagtgacatttaaaggcttaactaggtttattaggttaactagggaggttagggtaattagtcaagtcattgtataactatggtttgttctataaactatcaaaaacaaatctagcttaaaggggctaataattttgaccttaaaatgttttttaaaaaatgaaaaacggcttttattttagccgtaataaaacaaaaaagacagtctcgaaaagaaaaattattatcagacaaactgtgaaaatttaaaaaaagaataggggggggggggctaataattctgacctcaactgtatgttctaacatatgtcaccaaaaccctatgttcagactttctcttcgaccctatcaaagactagatctgacttcaactgtatatattatatataataaaaacaaatttcacaaatgcaaatccttagccatgcataatataacaaataatcatgactccaatacaaaacacacaaacaaaaaaagaagaaaatagaattagtaaaaaatgaaatatgtcttaatgattataaattatttgtttagtatgtttaatgttttttttattaattctaataaaaaatgaattacaaaaaaattaagttaacatcctaaataaaaattgacatggtgtttttctcctatgcgcctactgtttcttcaggtgtgctgagtttgagttgattaaaaactcatgcaaataaattgcacttcctaatttaatcaaccaactgatgaagtttggtgatatctgtcagtttaccctattcacctgcagtgtcttgcctaaattaaatgtttctcatgctgctcacagggcaaaacatctgttcagaagagcagctacgagcccatctggaacgagcaagtcatcttcacggagatgttcccacctttgtgtaggcgactgaaagttcagatccgtgattcagacaaggtgaacgatgttgccataggaacccacttcattgatctacgaaaggtttccaatgatggagacaaaggtacctacgatctgtcccagtgaaacactaacactgtaatgaatgtgcaggatgtacatccataaacagtggtttatgtttacagctccactccatctctctccaggtttcttgcccactatgggtccggcttgggtgaatatgtatgggtcgacccgtaactacaccctgatggacgaacaccaggacctgaatgaggggttgggggaaggggtgtccttcagagcacgtctgctcattagtatcgcggtggagattctagacaccacctctgctgagatcatgagctccactgaagtacacatggagccggtgtccaacatctcagaggtgagagtctacttgtacagtacatatgctgtacacatgcatgcttatagaatgaacaataatacaaatacagtatgcatggtgccaccattttttaaatatgacattaaaacaaaacatgtgaaattaaaataaaacatcattttgtgtaaaaacagttaaacacaaaaactcttctgtttacattttaccaggggtgtaaagtaactaattacaaatactcaaactactgtaattgagtgttttttttttttctcaggaatagtaatttactgagtagttttaaaaatgtgtacttttactttcctttgagtacatttatagtgcagtatcagtacttttactccaccactttccttcaacctgcagtcactacttttttttttgtctatgaagattaaaaaattagtcctgtaattcctgtccaatcaaatcgcacatagaaggtaaacgcctcatattgaactacctcaagacatgggcgatttataattacaattgcagtaaactatttggaatcgttaaaagtgttcaagaagatgtccaaaatctttacttgccatcacccggtgaagattaattcagacgcatctcactgatgagaagattaatgtttactgtatgatgactgaaatggccttaaacacccagcagccacaagaccataacatgatgtcagattgacgttgtaccccaaagtcgtgaagatgttgcattttgtttggaaataaaaatcggttgacatcattgtccaacgtccaacctaaaatcaactaaatatcagtgtctaatgatgttacagcttgaggttgtgtgggtgttaccactataatgtctattagatgttggattttggttgccatacttgacgaatatggcaatgtttgacgtcaatatgacgttggttcagacgttgacttgacgttggatttgggtcactttctaacacaacctaaaatccagcatcacttgacataataaaaaaacgttcttagatgctggctggacattgaattttggtcacccaacatcacaccctaaatctatcctaatattaacatcttatgatgttgtgtgcatgctgagcaatgactaaatgcactacagaacgttacgtttatacacatccacaaattagatgtaaatgcatcagctttttacagcgtaatactcactactcactactcttaaataattttgaaaggtctactttttactcaaacttttgtaatatttaccacagatactttttgcactacaagtaacttaagtaggatttttcagtactctttttatcactgcattttaaacacatacagtacatttcatacaaaaccagtcttaagttgcgtgtgtatctttttggcagctgtaaaattacacacattgttaaatacattgtatgggtcaaaactttaaaatattaagtaaagatcatgttatatgaagatatttttttttaattctactgtaaatatataaaaactaaatttttaataggtaatgtgcatttatatttttgtaaatattattttttttaaccataagatatagattctcaaaaggtctaaatataaaatgttaaatattgtcatatcctaacaaactattcatcaatggaaagcttattaaaaatgtaaatatacagtatgatgggttttgaggtccagtctcacatattttctgaaaaatctatcataaaattgtctataagttgcaccacagtcaaatttgtattgttttgagaaaattgatgtggtcatattatcaataatacactgtaattattcgaaagcaggcaaatatcaaatgtttaattattaatcctactagatttctttcttatagaataggatataaataatttgtataaagaaaaacttgaaatgagtgaaatctgcatggtgagcattttcactcattgaaaaaaaatatcttactgcatttctgttgtaatgtttgcacatttttgttggaatatttttatttactgtttaaaaaaagaatccaatttaggtaatctgtaatctctggacccccttttaccatttccaaaggcaaacagatcaatcctgattgtctaaaatatcaactgcccgttgggaaattacaaggccaagctctttgtcctcagacaagaagtcattgcatatgtgggagtccagccgtctgagattttgtgctgcctctgggagcaaatattgattgtcaaatgaattttactgaagggcaagattagttatcacacttgatgtggaggcaaacacatgattctcatagtcccaaatggctttgatggcatgtctaacctgccactttaaaaacgtttgcattgatccaagatatgtgaggaatagagatataaaaaagtgcaggccaaagatatgtcaaaggtgtgatcattgacatgaaacaagggagctagagacgtgcacacaaaatcagatgttttcctagtgataagagaaaaggttgagcagacttcttaaagggatagtttcctataaataaatgttttgtcttttttttcttttttttttaaatcatcttcttttttgtgtaacataaaaggatgcattttgaatactgtacattttctgtgcaattacaacaaacaaggattagagctttttaagcttcaaaaagaaagcagcataaaagcatcttgaaattatcataaaagtagtttttgcccatctggtgcattataacttttctgaagtcatgtaatagctttgtgagattcatttacatttccatattttccatgtagtgcaattcagtgtgtatcatttttttagatttccaaaactatttgttgtgacactggcgttgcaagacatctgattatcatttgcaaacaaataagtcctgcttgactgtatgctgcactataacaaaattattgagagagagaaatacatgcatccaagtgggggcacattaacacaacttgaaaaaaatgtcattgtaaactggctattgaaattttaacacagaagtagttattattaattattgtttcagtctttatttacatttattatcatgtgttttaaattcaactttaatattctatgaacatacagtaggatcaagttaacattgagcaaatttagtagtatcctacactgtaaaaataatacctatatttatatctactcaacaaaattgaggtgacagattacaagcaatattattaattgaattcaacagattaagtaacaaataaattagttaaattaaatgaattgacaacaattaaatgaaaagtactcaatgtttttattttgatttaacacaaaaattgtggagtctgttcatcagctataaaaatgtataccctatacctactcaataaagttaaaattagcaattaaactaaaataagcaattaaactaaaactagtcaaaacctagctgctggtgtaactgtaaaagtgaaaatttaatctcttctataatatttttgtcatcaacatttgaataaattgtcacagtagagtacagtaacagtacggaaaaaagttacttctttatgaatttcatttctgactttctgctaaggacagcagaatataaagagagttttatatgatcaaagatcatagcttcagttcagtgaaaacccctgctgggctaaaacatgaagagtcaattataatttctgactgaactcacatgcccactgttgggaaaaccctattcatgtctgagagaaattatgtgagagatctcgatgtaatgaaatacaaaacagtatagggtatctgttccacttcacagctaattattaaactatttttgtaactttgatcaaatcagtgcatggttcagacattcttaccttaaaatatcttatttcagacattgctgcctgccaatgttgctagaagacacatgcatatactataaaaccttttttatgaagcatggaaacactactaaactactattaaagggccatgaaatgttttgtgtaattttagaaacacataagcacaatctgttatattattgtaaagataatcatgtaaacactaaatgaggtggatttctctctgaatccccggttctgaatgcacacagtggatagcagtgcagcaggtctctttacccgtcttttccaaccattgccggtaatccggaggtatgtaaacatactgtaggcaaacacagcagcacagataaaggggatgtgactgaatggtaacaaactcaactgataaaagacaaactccgccgttctcctgacaaaactgcttcctgcaaaccaacagctttgctgtatctgcccttacagcatcgtgaggaaaaaaaaaatcttgtgaatcatggaaacaaatgcaaacgacccttaatgaatggctaaatactgcttgctgtgagcggacacggtcttacccagtcattgggtctcacagcttggcaggtctgcattgccttcgtaaagcacgtgctctcatgaataattaagaagcaggctcttcttataggataagaaaactcagctattaataataataagaaactgacgcacacattccactagcagatttgcaatacatcacagattttgatcccaccccaaaaattattttaaacccagaagatgaaattagctgacaaaagttctaaattttccagtttactccacaatttaagctgacaggtgctaatgtcgtcctaaatgatgctcaacacacacaaaacagtacttgagtgtgtcttgaacctttaaaaggattaaccttatttgttttatttgatttggtattatttgtttgtacatttaatgtataatttaatacttatacttacaatattgttgttatgactagctgatcttggtgtgtgtttagttgtggaggtgattgagaattgggatgggatgtaaagctgtattttgaactttgtatgtatcagatcttgtatctgtaaatagattttttaaaaatcagatattttttctttcagagtgctacaggaaagatggaagaatttttccttttcgggtcattcttggaggccacaatgatagacagaaaaataggagataaacccatcagctttgaagtcaccatcggtgagctgaagttacctgaagtctcttttcagttctttcacttttcaatatgctgacaaaaatagcaagcaatgctgtagtgatctcaaaacatcaaaatatgaagcgtatgctgcaccacatctacaccattttccacttaggtaactatggtaaccagattgatggtgtgagcaagcctgcattagcgaagaagaagaaggagggtggaggagagagtgaagaagaggagtctgagcttatccacaactccagcgaggaagaggcagaggatgatggagatctgacctctgtaccgtctacacctcctatgaagcctgttatcaccgacaggtcagagggaaatgagaatgtcaaagaaacacttcaaagcatctttaaattgtaacacatagttataaaatgactgtacaatgttagatgtatgaatccaaaaattactgtacagaagagtaactgtttattttcaattagtaccagctgctgccaagttctgtgtctaggtactaaactatcccttttgccttatttgcagaaattacttccacttgccttactttgaaaagaaaccctgcatttacatcaagagctggtggcaggaccagcggagacgtctctacaactccaacataatggacaagatagctgataaactggtcaggctcctgctaaaattgctatgtgactgttaaccgatcattctactctctctaagctgtttttttccaagttatttttgctcaattggacattagctacattaacacattaacattgtttagaattaaattattctgacataatatttaaacagtagatatttacatactgcacaaaaagcaatacatactgtttactttttttttttgtaataagaagctatttatatttgtgacacaggatcaagcctatatcattaaacagtatgcaataataccatacttattgtaaacgaggatatttatcaaattaatgtcttattggcatgagaaggtttttttccacctaagtacccattaaaaatttttttatactatacagtacaagcttccatgtgtttacatggggttcctccgtgtgctcttgtttcccccaaactccaaagacatgcgctataagtgaataaaataaactaaattggtgtattaaagtgagagtgtatggtactggattgtggatgtttgtggggcatccgatgtgtgaaacatatgctggaatagttggcggttcattctgctgtggtaacccctgataaataatggactaagccaaaggaaaattaatgaaaaattcagaagaatgggtgggcttgaacttaggttgatcacattgtcatgtttcttactccctacacaattgttattgaaaaatgggtgtaatttgtcattttggccaggcatttgtccaaaccaggagttggtgggcggagttgatagcccctgccagctgagctggctttttacatttagcgcaaatatatttatgtattttgggagatgataagctcatacatctttatgccatgttgctgatattgtgttaaataagtaaatttcaagcattaaaaatgccctttctggtgcctaattctaagcatttgtaaattagtgtctagagcagggactggtggcatgacatactgcaccagataacgactgaaagaagattttcagcatgacttatgacacttataagtgatcatcactagcaatattaccgtattattagtaaaattaaaaactgctgagtcaatattatgatccccttaagattttataattatttttcagtggctacagaacaaaacgttgttgcccactggttggcctaattaacttaacttgcttaattaacctagttaagcctttatattgcatacttaatactaaaatcttgaaaaatatctagtaaaacggaatgaaccaccaacttattcagcatatgttttacacaacgaatgcccttccagctgcaacccatcactgggaaacactcatacattctcattcacacacatacactatggacaatttaacttacccaatttacctgtaggctaccacatatctttggacttgtggggtaaaccagagcacccagaggaaacccacgcaaacattgggagagcatgcactctctacacataaatgccaactgacccagccgagccttaaaacagcaaccatcttactgtgaggcgatcatgctacccactgcaccaccgtgacaccctacaaaagaaattagttattagaaatgtgttattaacactattatgtttaacaattggttaaaaaagtatctattttaaacagcacttggaaaataaatgtaaaaagtataaataaatataaacacaaattatactggcaatgtgaatttttaagcagagaggactaacaatctaattacaaacatatatttagggttcatgagaacacagctaatgttcatgtctttctttgtaaacaggaggaaggtctgaatgatgttcaagagatcataaaaacagagaaggcatatccagaacgaagactaagaggtgtattagaagaacttagcacaagctgcaggtgacaaaacacagtgagctaatgtgcatacagcgcatgcaacaatcagtaatctcttgacttcttttccttattctccacaattgaagccggtttgttacacttgcaaacaaggatcagaatctttctggaagaaccaagctggacagagagaggctgaagtcctgtatgagagaaatggtactcccacacaacccatttagtttctgcttacacattgagaactgctgatgggaatgtaatttgcgtggttatattgttcacaggagagtatgggtcagcaggcgaagaccatccgcacacaagtgaaaagaaacacagttcgagataaactcaagctagtgttgaatttccttcagaggcttcgattcttagcagacgaggtaaaagaaatcacctgatcacttcctagtgaacacgatcagaatctcaaactttgtggttgattttcctcttagccccagcacagcatccctgatgtgttcatatggatgattagcaacaacaaacgcatcgcatacgcccgcataccctccaaagacatcctctactcaattgtcgatgaagagatgggcaaagactgtggaaaagttaaagctgtttttctcagggtaactcatgctttctatcccatctttataaataaatgtgttgattaaagtacttaaaggaacacttcgttgtttttggaatattttacaagtctcttggagttaaacatttgagttttaccatttttgaaactattcagctgatctctgggtctggtgggagcacttttagcttagcttagcatagatcattgaatcggattatataattagcatcttgcttaaaaatgtaagagtttcgctaattgtgctattgaaagcaaaactattttgtagttatgatttgcaccaagactgttaaaagttgctataggttgatatagctagaaactatactctcgttcttgtgtaataagctaagctaatagtgcttctgcctaacccagagatcagctgaatggattcatggctaaactcaactttgaaacagataaagtcaactgtttaaacctaggggacatgtaaaatgagccaaaaaagtggaatgttcctttaaatgactgaatgttgctgagattctgtttgtttttattacagctgcctggaaagaaaggttttgggcctgctggctggacagttcaggctaaattagagatgtatttgtggctgggcctgaataaacagaggaaagacttcctgattggcctccctagtggctttgaagaaaacaaggcagtaaagggaattggcatacaagctgtccctcccatcagcctagtttataacagtaagtttatatgccttgtatatactctaatggtttctttgctgttaatagagtttgcatgcatgaagctgactctttgtgtcctgatctgtagtgaagcaggtgtttcagctgagggcccacatgtatcaagctcgcagtctgtttgctgcggacactagtggcctgtctgatccatttgcaagggttttcttctccacccacagccaggtcacggaggtgagtgtgtgtcagagtctgaggtttcattatgtattttataatgaagtgttttaaaaaattaaattctggtattaatttctcatccctcttttcattccaactgataagcctttcatttgtctttggagcacaattttaattattttagattaaatctgagagcttcctccctcattctcaatagacaacaatgcctttaatatctatggaggatcagggagctctctgaatttttccaaaatatcctaatttgtgtttcaaagatgaacgaaggtctcagggtttggaacaacatgattaattgacagaattttaatttttaggtgaactatccctttattaaagtctgtataggtactttacagattgttattggctgttgcatatccacaaatacaataaaggctttacaccatgtagttatataaactttgttataggaacaagccaaactagaattttcccacaggccattaactggttggttgcattgtaactaataactgtgaagttcaagtgcgtgggccaatattcaataaaagttatgtttttgtgtgtgtttcatgaaactggagatggaacattgaggtataagtttgaaaagtgcaaaaattaggacaaaattacccatgccaatgtatagttctgtatacacgtaggtgctgagaaaagaatacagaatgcaatacagaatacagaaactcataacataacagcaaatgatgctaacattagatttctatatttatatgtgttgaaacactttaaaatatttagtcagtgttttgattaatctctgttagtttctgtggcaccaaaaatgggtacttccacctgtagttccaggaactactaaaaataaaaatgtttctcagatgagaaaccccctgttgagttaggtttgtctggctgactgttcatttaagtgcattttaacttcttaaaaacatgcttatatactttttttatatttaagtctttgcaaactatgttttatattagtttattttctttatatattagtaatatatacatattttatttataatatagaaaaatagatgtcaatgatatataataatatattattgttaaatattactcagctgatttataatgttgtaagttatttgggactgcaattgttgttaattttatttcattgtttatttatgcattgtacacacatatatctaattaattaaaagtgccatgattaaaccatatatataaatatataaaaagctattacacttatatttatagtaaattaagtaaacttagtaactttttaattgtttaaattgaaaaaattacagttgaaatcagatttattaaaccccctttgatttttttttctcttttaaatatttcccaaattatgtttaagagagcaaggaaatttacaaagtatgtctgattatatttttttcttctggagaaagtcttttttgttttatttcggctggaataaaagcagttcttaattttttaaaaaccattttaagatcaaaattattagcccctttaagctatatattttttctgataatctacagaacaaaccactgttatacaataacttacctaattaccctatcctgactagttaacctaattaacctagtcaagcctttaaatgtcactttaagctgtatagaagtgtcttgaaaaatatctagtcaaatattatttactgtcatcatggcaaagattaaataaaccagttattagaaatgatttattaaaacatttatgtttagaaatgtgttgcaaaagttttatctctgttaaactgaaattggggaaaaaataaacagggggctaataattcaggagggctaataattctgacctcaacaactgtatataggtagttactgttgttggtgtcacagtggcacagtgggtagcacgatcacctcactgcaagaaggtcgctggttcgaggcccggttgggttagttggcatttctgtgtggagtttgcatgttctgcccgtgttgacatgtgtttcctctgggtgctctggtttcccccacagtccaaagacatactgtataggtgaattgaataagctaaatttccatagtgtatgtttgtgaatgcagagtatgggtgtttccctggtttgggttgcggctggaagggcattgaaacaaatgctaagcaaagttggcggttcattccgctgtggcaacccctgattaatagagtgactaagctgaaaagaaaataaataaacaaatgacttttgttgttaaaaatcatcctattttataaatcatcaacctatttctgctgtatatttcaggtcctcagtgagactctctgtccaacatgggatcagctgcttgtgtttgataatgttgaactttacggtgaggccggtgaactccgtgatgaccctccaatcattgtcattgagttgtatgatcaagacactgtggtaagttagtttcaaaaagtccacaaataaaaacagaatatccaggattgaatgctagttcagcattttgttgacataattctccccatgtatgcgtcacgataagagtgtgaaaatgtgctctattgtcctgacttgatgtttcttcctgtttaaaattttctggtcctgcccttttgttggacggcattttggctaagtagagtgtgaaagcttatttcaacactgctgtcaatttctgtttgcatagaaaactgaattcaacaaggcatgcaaaaactggcatagcttggaactaaaaacaagatctttcttctcgctatttccttacttgttgataaaaatacaattttctgttgcgataaacctcttgcattccctgtgttgtgacagtctagagagctagctagtggatgtttttttatagctgtagtatttgtagtctgtagtaatgattgctgtggtttatttaattgagaactgagggtcacggtcaaatataatattaatgatcctctatttataatatttagacagtatttgagtgcaaatgttttggtttgaaatttaatcaaatcatttggaaatgacaaccaaagattgattttcaaatcttaaagccgcagcaatacagtagccatgatgtgaaagtgatttttcaagcaatgtgcccacactgccccctggtgtttgatgatgatattgcaactgctgtgttttcgtgtggcatccaggggaaagctgagtttattggccgaacatttgcaaaaccacttactaagatggttgatgaacactacggcccaccgcggtttcctccccagctcgagtattatcagatctaccgaggaaactgtgctgcgggagatctattggctgcttttgagcttctacaggtatacaatgattgatctacaagtacaatctcaaatctccactgaactctctgtcagtgcttggcctaaattttcttaaaatttgcttgaatagtacagctgtgaatcactcttctcttttccttccacttgtccttgattcttggtctcttttttttttgtcatttcccatcttttttatgtcctgtcacgtttgtctgctgtactctttcatggcacctttgacagattccttatgacgatgaggagatcagaagagctcttattgctgtccatgactttgctgtgcctcagatcaaggtgcaataaaaaagtagcattttctttctttaattgttatctttgtttttcattcgtctgtcagtgactccatcctctttgctattgctgtgctttgctatttttcatgttttacgagatttaatcaaaatcgaggagttaatcagcaatattagtcagtcattacttcaatattctttttcagttatgttttagatttttcatttaaaatatttgtttataaacagattggtccagcagggcgggcagcacttcctccaatcgatggaccgaccgattctgaccgtgggcccattctgcctgttccattgggaattcgaccagttctcagcagatatcgcatcgaggtgaaaacatgccccagccataataagattattaaagtgctcctgtgctttcatttgtgaatgtagctgtttgaatgtaaaaggtctgcaaagtgcaagttaaattgagttattgtctcctaaaagaaataactgattctgacctgagtcgtcggtacttctagttttacttaatggacaaacctacttgagtttgtaacagcattgcatttgcataattccagcctatggtctttattggttgcctgtgggcacgatgatgctgcagtgtacagtcaagctcaaaataattcataccctttgcaaaattggatttaaagttacttttattcaaccagcaagtttttattattattattattttttttttgactggaaattacacaggcctctcccacaagaagaagatgcaacattgaggaaaaaaaaaattttaagtaaaaatatttatttaagtaactcattcattcatttcttttcggcttagtcccttcattaatgtggggtcgccacagtggaatgaaccgcctgcttatccagcacatgttttactgcatgcccttccagctgcagccaatcactgggaaacattcatagacactcattcacacacacactacggacaatttagcttacccaattcacctataccacatctttggacttgtgggggcacccggaggaaaactatgccaatgcggggagaacatgcaaactctacacagaaatgccaactgacccagccgaggctcgaacctgcggccttcttgctgtgaggtgattgtgctacccattgcaccaccatgatgccccctctttaagtaactataagtcagaatttaccaggggtatgaataattttgggcttgtctgtatgtgtaagaaactttggatggatgtaaactttttgaaggagactttcacaataagactaggaacttttttaaaaagcatattggggcactttattaaaggcctagtttacccaaaacttttatcaacatttactcacccttccaaacatttataagtatataagtatatatatttatttctgttcaacacaaaaaaagatattttgaagaattttggaaaccggtatccattggtgtccatagtagaaattaaaatactacggaaatcaattatgaatttcaacattctgtaaaatgtcttcttttgagatcatcaagatttgaaacaagtggagggtgagtaaatggatttgactttgtgtgaacagttgttttactacatatagctcatttactttttgcttcaatatgattattattattagtattattattattattaatgtttttttttgtttctcacctaggtcctgttttggggtctgagggaccttaaaagggtcaacctggctcaggtggaccgacctcgtgtggacattgagtgtgcagggaaaggagttcagtcagccctaattcaaaactacaagaagaatccaaacttcagcacattagtaaagtggtttgaagtggtgagggaaattatacagttgttgaaaatgtaaaaatatctccaattcttttttttttttttttggaaattttaaaattcaagcatttttgtcatgtaggatctgccagaaaatgagctgctccatccaccacttaatattcgggtagtggattgcagggcattcggacgctacattttggtggggtctcatgctgtgaccacccttcgcaagttcatctacagccccccagacaagactgctaacaactgggctcacacaggtacctgtcatatgcctactatatatacctactgtatctgtatataacaaaataatattctatttaaaacttttcttgatttccatggtttcagtagcatcaaattttcctgtgatgatactgaaccatgccccttttttacaccatatattaaattaacatctaattaatatatgaagtgattcacttataattggatacactactgtgcaaagtttggagctagtaggattttacactgtttccacaaaatatatctctgaaaaaaaactaactgatgatcacagttactattggttgactggatttgccattaaatgtaaaaaatgtaaatttgtgttttgttttataagctattgattaaagtcttcatattttaaacagaatatataaaagcattttaggatgattttctgttatgacagtagaaaatgttttcattgaactgaaataaacattgctgttatgctgtatgtttacatttccaaatacatgcagccttaggagcataaatgagtttccaaagctataaaatctgaccaaccccaaacatttgaataatagtgtataagacaacttgctatttcctttttccaccttttctgattttccaatcctttcctctcttctttctttctttgatctcttcgtggttttatcctctctgtcttgatgctggtctctggtcattggttgatgaatcttatgaccctgcccacaccagctagactggccaatggctacctggctctcagcaatgggacgtctcattcccgcccccaatcccgtcctgtttcttatccctcaggtgacattgtggtcaacatgagccctgaacctaacattaagaagatggacacggttgtcaagattgaagctgtgagtagtggaagcatgctgtcgtgtgttagaaaatgactttgtttttattcacgttttgtttgttttactgctttaataaataaaccacccaaaaatgaaaatttactttctttcttttaagaaaaaaaaaaagatattttgaagaatgttgctgatcaaacagtttcaattaatttccaatggttgaaaaaacgggttgtttaattgttacgttttcaaactttttttaactatgatctttctttgcattcattattgtattttttaaatcatttttttacttaataaatgaaaaaaaatgctaagtaaattaaaagttttgggtgaaccattcctataagcttagtgtcctattttaacaacagccatcatgcaatgtgtatgctagtgagctattactgtggatgttgtttgtgctgtatttgatgtatgtcttgtgtgacctgtgcttgtagaccaccgatgcggttgttaaagttgacttggtaagtctttgcttggtttagacagattcagacagataatgtttacaggaacctgaattacaaattagatttaaaataatataagcatcacaactacctttgtgttaacagaatgaggatgagaaggagaaagaaaagaagaagaagaagaagaagaaaggagaagaagtggaggaagaggagccggatgagagcatgctggactggtggtccaaatactttgcctcaatagagactatgatggaggtgggagaaactgcctttctgttcaacttccttcaagattcttttcatttttactttatatatatttttttaaaatgctgtgcgatatcctgccagtaacagcactcgtccagtctcttaaggcttcaaccttgtgtatcactccgcccacatacagcgacaagcagaggacacagtttgacaaatattcctgctgttgggcaacacaatgtactttgaggcttttttagtcgagaatgtagttgttcagattgcaactatgcaatttatttacaaggatagtgccaatttttaaaaatatttataatttctgagtgacagcgtgtcagcggccattagcctgtctttgagcaaagacggttgataatgttcatccacaagatggcgtcagagaccgcataataagccctaagagaaactttctaagtcgatccctctcttttgtatgttgtagtgctgtatttataccatagtaatattgtgatctccctattgcaaaagagaaatacatctctgtagactgatggcctttcatgccgttcagccttataatcttaaaatgtgagcaaaatcacctgttttgtcttcactttagacattacgctggagaatcattcaaatactagctcttaagtgacgttggtgaagtagctacggtttctgctgttttgacttcagctgcagatgtgtaggattggcgaagaaactagttcctctgattaaagggttttgagactctccgtgtttgattttctttttcttatacacacgattatgccgtcaaactgtggtattaacgcaatgtcacatgagttgaggtgcgatgtggctgtatattgtcactggtaggacactaaggcactcggccgcacgcctcccaccagtgtcgatatacagcaacatcacactgctacttgtttgatattgctcatatatatatatttatacagtatatagcggctttaaaatgagtttaaataaattcaattattattttagtttattaaaggttaaaaaatctactaaaccattaccacttttttctacaccctatgataatttgcacaaattatgaaagtaatttctgtaaaactgtaaataattagtaagtgttttaaagaaggagtccagtgaagtaatattctcctcactattctattatcagattttaaaagaaaactatgctgtaaatctgtgatcctgctcttttattcccttcaaaatgtaatttgaaatgtcctggaaaatgaaaaattaagaacctaagctaaaagttttggttttagttctgcagaatatgaatccatgtaccatctctttaataatatggaatgtgtcatactgtattttacatcacaatatactttctttgcagaatctaagagctcaggaggccgctcaggcagaggcagaggaaagagaagatttggagattgcagcagagagtgcaggtaaacacagaatttagtgtggactaaagcatagatacatgtttagatgagcatcatcccatatccactgttgtagtcactgttgacattaaactattagtacgtatctccttttcacgccatgaaagctagaaacatgttttgatactatttaatatttcctacttattgggtacatttatgctttaagagtgttaatataataagttacagctattattattattattattattattattattattattattattattattatgagtcatctgttattttaggtctttaactctcatggcttgaaacatcactgttcactataaacatccattcagactgtcattgtgctgtaaagtagatgtgctcacatgtctttcatatccattcgtacctacccattcactcctaacctcagagatcaaagctgatgactttcctatgaaaggcaccaaacctaaagagaagagcaaagacaagaagagcaccaaggacaaaaagaagaacaacgatggcacagaaaaacgacctccaaaaccaaaagttgatgaactcatggtcagtgcttcttcttgaacatattagtcttctattcttgccttgtaaaaacaaattcatttgaaatgtactcacactactgtttgtcataagaaagatttatgtgtttatgcatttatttactgaaaaaaaacaattagttgttctctttgaataatcctgttacattaaggactggagtaaaggctgaaaatattcagatttgacatcacaggaataagttaaagcttaaaatatattaaaataggaaacatttaatatttttgagtgtttttgatcaattaatgcaatattgaaaagtgtcttccacactttgtaacagaagtatacaagataaaagaactgtaatctgaagaaatccaagctaaagatctttatctcaggtgtacaataaagagctggagagtgagttcggtagctttgaggactggcttcacaccttcaacctgtaccgaggaaaggctggagatgatgatgaccacaatgtggttgatgaggacagaattgtgggcagattcaaggtaagaatgagtaaaacacaaaacactgtatacattcaaagtgtgaaatgattttgatattttgtcttcttatgaaccagggctccctctgtatgtataaactaccactgtctgaggagatcaccagagaggcaggatttgatccaaacatgggcatgttccagagtattcctcacaatgaccctatcaacgttcttgtcaggatttatatcattcgagtgagtgtattcaactccaaagatttaagttgacttcacttgtgtgcacacaataacatgtgtgttacaaaatgtaaatgtgataatagcagacacttaaacagtacactatacatgcttaccatataagtgatgtgcagtgcactatatgcatatccattgtatgtataaatctggtgtatacattagggttaagttgaatgtgttttatgcactgttccttatctgctaaatctgcttaagaaaaatgaatctctactcaggccacagacctgcatcctgcagatataaatggaaaggccgacccttatatagtcattaaattgggaaagtcagacattcgagacaaggagaactacatatccaagcagctgaatcctgtctttggaaagtgagtagtaatccaaacaaactagtcaagtggatttcgtttaagctagaaattttagtttaggtaccaattctcactattaaatggagttaacttgttgaaaaggttcggcggcggaaccacgcctcacacctactccctattttctcgaatctgcacttgcagatttttagcccatcattgattctgtttatttacttgtgtaaatgtgtgtaaattcatatttattcagtttttaaattaaattcagtaatattattgactaatattaaaacatttatatgatttatttacattatagtttgtaaagttatattttctgtcttttagtagagatattatttgagagatttgctttgtttgccaaataaatgatctaattggatttgcattgtaaacaattcatacaagtttaaaatatgttacttttagttcatattttaaggttttagtcatgacactcccaaaataattagagacggtacccccactctaagattttgggcatcatcgtaggatgcccgatcaacctacctacctgttcactgtttatcatcttatttcccttccccttcatgccactgttctcttaccatccccttcatttctacgataaagtctagctcaaagtttgctgtggtctatgctggtgaactagtggtttattacttgcctattattaagatattggctgtttatttgtgcttttaaactacaaattcggcctgatttttttctgcatctctcataataaccaataactaaactactacgttaataactattaatgagcagggaattagaagtgtattgagctaaaagtcatagttaatggtttgttaatagtgagaattgtaccttaaaataaagtgtgataaattttttttattataacttaaaaacacaatctcctttctccactctccataaggtcatttgatatagaggccacgttcccaatggagtctatgctgactgtggcagtgtatgactgggatttagtcggaactgatgacctgattggtgagactaagattgatttggagaacagatactacagcaaacacagagccacatgtggcattgcttccaactactctgtgtaagtgtcttccactgtttactttctacaggaaggtagcacttaatgggtgctatagagtgttttcattttggggttgtcaattgctaatagttttttttttttgtgatgtgacaattcatgaaattgatttcatatatcaacccatatagaaatctgatctatggtaatatatgcaacttacatacatgtatatggcatagaagttcatattttgatttcacatatataaaatgtaaatatgcaacatacattataaagtattgcaaaaattgttccacttatttatttatttattaattaatttatttatttatttattatgattcacaccccagaggtatgtaagcgaacatttttgtaatatttgtaaaatgcaaatatgaacttgtatctcttatatgcattttgcatatgtatccatgcatcatttttctttatgggaacaactaaaactagaaaagtaatgtacgtaagcaaaatttatggtggcttgagaaagcctagcctgaaagatagaagtagttttaaagtgtaagtacctaaaatagttttataagaagtttgaaacagttggcatagatcagtggttcccaaactttttgttgtgtgcacccctttctaatatttgacacctgtcaagcacccctttctccgattaaactccacctttttaactacaataactaaataatattttctgtatacattattaaaataaaaataacaaaatacgtgaatttaatggttgagcttttatgaaaatggcaattttcacagttcatctggcatgtttttcatcgctagagcttcttgatggatgctgcagtctacccgggaaactgatggtccattcctactgtcacttgacttctttaaagtgccagtttttatccaggtgtccattttgatgaatatagtaagcaaaaacaaaaaaaaacaaaaaaaaaaacaaatgtactattccttagcgcctaatgtgaaagggtggggcttttgtgacgcagacgtgaaaccgcgacatgattgagcatgcataggttgtaaattacaatttatatcgtgtttttttctctctctgtgaatttattttccctcaaaaatatgacatctgaaattcacccaagatacatgcattaaaataaaaaagataaattcttccaccattaaaaacattctctcgcacacccctggtggtcagactgtgcacccctagggttgcacacaccccagtttgggaaccgctggcatagatagataagcacatacagttgaagtctgaattattagcccccttttgattttgattttcttttttaaatatttcccaaattatgtttaacagagtaatggaattttcacagtatgtctgataatattattttcttctagagaaagtcttatttgttttattttggctagaataaaagcagttattaatttaaaaaaaaaaaaacatttttgggacaaaattattagcccctttaagctaatttttttcgataatctacagagcaaatcatcgttatacaataacttgcctaattaccctatcctgactagttaaccttattaaccaagttaagcctttaaatgtcactttaagctgtatagaagtgtcttaaaaaatataaagtaaaatattatctactgtcatcatggcaaagataaaataaatcagttattagaaatgagttattaaaactattatgcttagaaatgtgttgaaacaatcttccctccattaaacagaaattgggggaaaaataaacaggggcgctaataattcaggggggcttataattctgacttcaactgtatatgttagcatgtttctaggatggattggaatgtttcttgctaggcggttgatagtggttcggagtggttgctaaggtgtttctaattggccgctacggtgttctgaatgcttgctcagttgtagctaggtggttgctagggtgttctgagtggttgctaagcggttgctaggttgttttgactggttgttaaggtgttgctagacagttgcttaggtgttcttagtggttgctaggcagttgataaggcattgctagagtgttttgagtggttactaagcattgctaggcggttgctcgggtgtcctaggtggttgctaaggtgttgttaggtggttgctaaggggttttaaggggttgctagggtgttcttggtggttgctaaggtgttgctaggcagttgctagggtgttcttggtggttactaaggtgttgctgggtggtaactaaggtgttctgagtggttgctaaggcattgctaggtagttgctaaggtgttttaggtcattgccaaggggttgctaaagtgttgttaggttgttgctaaggtgttctagatcattgctagggtgttctgaagggttgctaggaagttgctaaggttttgctaggtggttgctaaggtgttaccaggtggttgctaggtggttgctaagatgttgctaggcagttgctagggtgtgctctagttgctaaggcattgctatgtggttgctaatgtgttgctaggcggctgctaaggtgttgtaggtcattgctaaggtgttgctaggcggttgctaaggtgttataagtagttgctagacagttgctaacatgaattgaattagcatggttctagtatgatttatcatgaggctagcatgtttccagtatgaactattatgttgttagcatgaatttagtatgaattaacatgttgctaatataattagtatgttcgtatgtttattagtatcgagtatggattagtatattgctagtatgcattggtatgttattagtatgttcaatgtacagtcaatggcagtattttcacaatggaagtcaatgggacagttgctaagatgccataagtagttgctagagtgtggctagtaagttgaaaggtcatcagtgatcggcagattggtagtctgaattaaatgagccaatgggacttttccaaatgctccgggtcagttttcggaaaaccgtaggtcggatcagttggaaaagatatagcaatgtaattcagtgtagtttggaggtttggtagttgaagtatgaacggtctaggaaaagatgtgctcctaaattattctcaaaagaagaagtttattccagtatgttggctttctcaagccaccataaatatatcataataaatttgacaaactgaaagtctttggtgacagtaggtaaaagttaaatttaattctcatcaaatccatccagccatggttataatgtatggagagatcctcagaaaccagctcagatcctggctaagttgtgcaaagaaggtaaactggatggacctcactatggacctgggggaagagtcaaagttgcaaaccggatctttcttgggccgacagaaattgaggatgagagtggtgagacatttgtaaagctaatatagagcttgtattgatgtttttcagtcatacgtgaaaacatattgattttgtttggcttacaggtctgaaaaaacaaacagaagaacacttggcgctcacagtccttagacattgggaggaaatcccacgtgttggttgcaaactcatccctgagcatgtggagacgaggcctctcctcaacccagacaagccaggcatagagcaggtaggaaagagtggacaagaaaatagtgctgggatcatggttcacactgtgttcttgctgaatttttcatcattggaaacaaaattcagagaacatgatggattattttgaacaattgcatattaataatgcctgggtcaatgggtagtttatttcagtatgttgagctggagctttcttttttgcttatcattcacttataacgaactaagggtaagagggaggtgtttaagaatattgtggctgaagccgtcaaactgacgtcaaaggtgacagaccaccactccaaatgtagaagcaaatggtcagattttgattgaagattactgaaacctttttttcagtggataaatagattaattaatcacttaaatgaattgtgtggtagaaaaataaacatggtaaatttagattttacacagaatttaagatgtttccagggaatccccctaaaacagtcagttgaggcattttgctttactaccctgctcaatttccttattgaagctgagtaaaaagttattttaaaggggagaaatcatcgcctgctcagaccctatagggattggtgaatgaacagagattctgttgtgattgggcaatgggcagaattttgtcagttatcagttcacaaaactgcattgaacagttaatttgtgaattgcacttctctgactgcaactgttcttaagttaacaactcactgattcaaatgaggcgacgtagtgatgctgtaggtaatgctgtctcctcacagcaagaagatcgctgattcgatcctcggctcagttggcgtttctgtgtggagtttgcatgttctccctgcgttcgcgtaggtttcctccgggtgctttgtcttatgtatttttgccatagactagtgttttctttcattcatgttcctttggcttagtccttttatttatcaagagttgccacagcggaatgaaccaccaacttttccagcatatgtgttacacagcggatgcctttccagttgcaacccagtactgggaaacatccatacacactcattctctcatacactacggccaatttagtttattcacttaccctatatcgcatgtatttaagccaggtctcgaaccagcgaccttcttgctgtgaggtgacagtgagccacagtgtcgccatactagtgtactgtatatgatatgttattttttgtttccactattgaattattatgcattatggatatgacaacttttggtaataaatttttcttgcaaaataaacattcatcagtaatacttttaatacttaagtacattaaaaatcaagtacttttacattaagtgaagtttatttataaactaatttcgagagtatcacatgctaaagattgcttgcggctggcccagcattatccaattcatgataaatcaatcagacgattcctaagtcactataaatgccctaagttccatatgacagccagctttattttgaaaaattcctccttccacccctactgtggcccagcggttagcactattgcctcacagcaacatcacctgttctagtccttaccaagccagtcgacgtttctgtgcagagtttacacgttctcgccatgctcacgtgggtttcccccaggttccctggttttctcccaccatccaaaaacttaagttaattgactaatccaaatcggcaccatagacatgctccttctaagtagttttctcttaagagcaatcactatctgttcattagctactacagcaggggagttcttgagatctacctgagctcaaactcccctcttaccctgcaaacgggaaggagcccacaggctcaagaatcttatgagctcagggctctcagcatgccaaacaagctttataatcaatcatcagctaaatgtgaactcttgaaatgcaagtaaaatttaaaaagaaggctttatactttactggaatatcattttgttggggcattcagactttcacataagtgcctgatgatgtgtactttatccaccaattctgaaaacgcaaagtggtgcatttgatcattgttttagtgcaatatcaaatcctcaattgttttctctcaatctcaaagggaaggattgaaatgtgggtggacatgtttcctatggatgtcccagcaccaggaccagccattgatatatcgccacgcaaaccaaagaggtatatgattccattattttatttcatttttagttcaagcttttagtggtttcagttattcagttttaaggaattaataattgacttgtgcattgtgttgcagtcatttcacatgctttatcttaaggagtatgcaactatactcaactatacgtatgcaactatactattaaaaagtcccattttaatacagtatgtgcatcagtgagttgaagatgagactaaaataggaagctttaataatcagtcctgctgagatcacatactcactattagttcattgcaccctcaagcgaggaacagattgctttatttggactgtgtgtgcaattaatattctttggatgatttaatcgccttggatgaagccatggctttgaatggtgtattgccaaactaaagaaggtcttttttttcttctgctgtctcttataattgtttactatcattttcaattgtgttcgactacagtgatacagctagagtttagagacaaagaaaccactcagggtttgtagataaaacatatctttattttcctcccatatttactctgccagcttcgcacctccatctgcattaatttcttctttttaatcatctaaaataaacctccacaacaaaatcaaatacaagaccaggcatgtgcattaagaaaataataaaaagttatgattactaatctgacaaaattacatgtcaagattaccacattatgcatttttgagggttaaaaaagtttttttgccagataacaccaaaaaatgttatagttgtaattaaaaacttatatacacagcatattgacattttgactttcatcagctttcattatattttagtttaccatttttattcgtttctgttctttgatttcatatattttaatttagttctgttttagagtgtgtttagtgtgtgtagatggcgtgaaacaaacttttgcagctctccacaatcgttctctgaccggtcttctagactattgcgtcttgttccctgattcgtcaggatcctctcatatgaccgttaagcaactggtacattgcaagtacagatggcgcacaaaatgcacatgcccagtgaagatgaagggtcacttatcatgcattttagactgtttagtgtggaagaatactttttttcctgaaactcagtaaaaacacagatttagaccgggagcaattttattctaatgtgacattattaataaaacatgcactattttgaatgcagtctaatgctgttttcacacctgcattatttagttcacttgaatcgcactagagttcagtttccctcttagtgctttttttttttgggcaggtgtgaatgtagcactcgagtgtgcaccaaaagcagaccaaaaaagtgtacagaggccttcttgaagaggtggtctttcaaacgaaccctgaatcggtttgtttggggtgagaacatgatctgaactaatacagacccaactgcaaaaagtattgcacctttttggactaaacccagctgatgttgcaaagattattgaatacacaagacatgtcactctttttgaatggggaaaagtttaacggtcattatggtaaatgaagccccacctactagtacaggagccaatcatcgatcactatatggcgaataaatcccaccgtccaaggcgatcgctatagactgacgattctctgggacaggggctcggaccagacgtgagtttctgcagattttgtgtgatttagatgtttagaaattaaactaaagacacagttatagtttaattttattggtgtttcctaatacgaaattttattgtaagcttggcaagcagttttggagaatatgatgttcttccattcagacaaaatgccagagcataatgccagagaggtgttttaaagatggccactgagtaaaatgacttgccttaaagggactttgggcattggcattttcctgtatgttaattctaaccaatcgaagtgaagtttcacaaactaatttcgagaggagcatgtgataggattgactgcagctggtccctatcgctattagtaagccaattggataattccaaatttaacataaatatccaacctaacttcattccctatcttcgatccctatcttcatttgtcacatgactgcatttttgttcatttctattggttcggactaaaaccatcagtgtgttgtgaaaaggcagaaaacgacagaaaaatgctaaaatgtataatttgttgcccttggtccggaccaaaggaaccaaaccacatatgtgaaagcacccttagagaaccagaactgactgtaaagagaacacaagtgtgaacacacctttggtttaattcatttcaatttagtaacttttattttttctattaagtttttacacttgattcatctcagttttcaaaaatgctcttcatagataaaacttcattgttttattttttttttacagtagttagtgataataacctaggtttgagatgatgctctcattgttttccttcccctccactcgtctcccagatatgagctcagggtgataatatggaatactgacgaggtaattctggaagacgatgattacttcacaggggaaaagtccagtgacatttttgtgagggggtaggtatgggcagctgtgtgacaagtgtgtggttaatcggttgcctttgtttgtttgtttctgtttccttttgtttgtctgtcttgttgctttggtgttttttttttttttttgtctatccccctccttgcccccgcgtcattgctgtgctgttctctagctttgagcttcgtgttattatttggaacactgatgacgtaattctagaggacgatgctttcatgacaggagagaagatgtcagacatctatgtcagggggtaaagacgacacgatcgcatggcttgactgctctgcccatcagaaacctgcacttaccccttccatttaaaacaaatgaatgaaaaaccacctttcacatacagtagatccaagttaaagggttagttcaccccaaaaaattaaattatgttattagttacttcccttcatgtcgttcaagttccctgagacctttgttcgttttcggagcacaaatgaaaaatattttagatagatagatagcaatggtcacaagacattcaaagtccagaatgaccaaaaatggccagataaatttaaaaagtcaatattttgacaactttgaatgtctcaggaccattgctatttatgagagagctcctggagttcatctaaaatacctcaaaaggatccagggtattgaaatgacatgatgataagcgattaataacacaattctcatttttgggtcaaataaccccttaaacaggaccatatcattccaaaagtggctgttttacctctgaaataatttgattatatgcgctaaaattagtagaaatgtaaataattggtgtacattaaatatatatatattttttacatttaacatttaatagttaatgtaatattttataactggtatggtcttggtttgttggtacatttttttttcaaatgtcttggagtctgagatgtctttctaatcaattactgcatgaaagcataagatctgtctgtttgcatgccaaaactagcatttgcatactaacgttttgattctcgatccgtctcaagaattgaatagatttttttctatgcatgcatctgctctatattgttgtctataatagctgaaataaatcatgatacacgggatctttgtatattgctgatttattgggacaggctactttttcaaactgatacgctttacaacttaagtgcaaataatggagttgatacctggtcaaggatctctttttcttttttatttgcagagagtgcaggagtaattgcatgcactctttttcaaattagattattaaaaaaggagtaacatgcacataacacaagtcaggaactgatgatctacagtacacattatttacaattttatgtttttttatagtataaaaagtcaaatttttatatatattaagtggttaaaaacactaagtatagggtggaatatgtttgttttttttgttcagtttcctgatgcattatggattttcaatatataatgtataaattatattatgcatgttgtctctggtatttccgtctatacattttagttttacaagtttagaacatttgtgcatgttttgttgtgcaagatatatgaggagtcattgttgatcctgttgcttgtaaattgtttgtataaatattaaaattgcatgtaacaattgaaaaaaatgttcctctgctcagctggcttaaaggacagcaggaggacaaacaggacaccgatgtacattatcactctctaactggagagggaaacttcaactggcgctttgtcttcccctttgactatctcatggccgaggagaagattgttatctccaagaaggaatcaatgttttcctgggatgagactgagtataagatccctgctcgactcacccttcaagtatgggatgccgatcacttttctgcagatgattttctgggtaagcttacaattaaacatttttaaggctctacagtgtgaccgtgtctttttttatttctggaagctctaaaggttgttgttggctttggacaagcaattcaacctttaaataaaaaaaaagaatgttggtttttttatgtttaaatggctaaatttacatggacatcagtaatcaaattgtttgccttaatttcaatacaacaataatatgattaaggtgtttacatgacttgtctcttgaatgttcttttaatgatcctgttttacatgttatagcacatcattcgattaacgtcattgcagcacagagaaattggatgcgagtataaactgctggaagagtgttgttttaatggagttttatactgcatgcaagaaaaaatctctgcattttgcggtgtgtgtctgtagtccttcactgacttaagtgcagagaatagtgtcaaacagccatgtgtgtatagactatcctgtcgctaaaaaagatgaattgtcctacatgacggtagtttggttgcagtgtttacatgtctctactgcacttcaataatgcgactaaaatcggcatactccttgtcttagttcagtttctgttaagtttgattatgaccttaatcaaattaaggtaatcaaaaatctgtttacatggtagactcttaatcagagtattgtctcaattaaattattggtgtccatgtaaaccatagactgtaaaagattatggatgtagtatcagtgatgtcacccataggtttttgaagaaccaaaaagaagctaccagtaggcgtggccaaccgtcaacattttgtttgcccgtcatcgcaccaactggggaataccaaaaaaggtcaaagaggcggagcacgtgtggagcgacagacttctgccggcattttgcttaggcttttatttgaaagaaatgcttaatactttattgtctgttacccagtttgtgttttgaccacatgtgcttggttgtgtactatatcaataatgtgtaaagtcttttaaaaaaatgttgtaatacattgagccactgagcattgttcttatgacgtttttctacaggagaaaaacacaaattacttctaaatactttaaacacttttaacacggactatagtctgtgttagtaaatccaagactagtcatgaaatccaggcatagcactgcatggcaatgcttcagatgactgttctagagcctacagctaatcagtctgtcagattcttgagtgcattacaggcctaaaaaaaaaaagataaattattttaaacaaaacaaatcaaaaatagatatgatatataagtacataatttcactcacctgggaaatggaggccacttgaatggtttgtgagcacagttaattgcacacagcatgccatatcatctgataattgtaagaaataattccaaaagacaactgactgtgtaaagctgcataaaacataaaaataggatgtatatgcagatttcagcagttaatcagctgtaatcagcggaggtgaagtaacagtgacctacctagttgtcactcaagtggccacacccttaattatgcagacctaataaaacctaatataaaggaattttattgttgcccttgttttttcttttaaattcacacccctcagttgtcatgaaggataatagctatatacacctaaattgttctttgtaccgggctgtaaacactttttttttttgcttctgtaaagttggccattttagttgtgggttcattataaatttgctctgtatggagccaggactagtggaattttgatgaatttcacagtttcagttacttccgtactcaatgtcacggacattagatggtctttcatatatcaccttctacagtacagtgttcaatttgaacagtcattttccaactctgcatttcttttgtatgttttttaatgtcatgaaatatgtcttacatttcatttatagtgatcttaaaaaggtctttaaatgtctttcttttgattaagtaaatcttgtagaaagcctgtaactcttttaagagtaaatccttctgattattttcacaggtgcgattgagttggacttgaataagtttccgcgtggggcaaaaacagccaagcagtgctctctagacatggttctcaaagagcatgagctgccaaccatctccatcttcaaacaaaagagagtcaagggctggtggccatttgtggcccaaaatgagaatgatgaatttgagctaacggtgagtttatagaatgttgttaatatctgctgcttgatcatttgttttccagcatatgttgtgctaaaataagtgcattcgtttttgagctcattgatattttacttgtttacagggaaaagtagaggcagagctccatctgttgacagcagaggaggcagagaagagtccagtcggcctggggaggaatgatccggagccacttgagaaaccaaagtaagacatatagatgtttgctctagctcacatggtgcccatctgagaaataatgcagtttcagcttatgaataatatcttatctgatatactgtagataatgaaagtctttgccttaaaacttaacacaaaaatgtaactgaaagataagacataatattgcatgcattatgaggtataaagctgccttgggaaataaaagtagtgcagggtgcctggaggatcttaaatttaggtctcaaaaagtcactgaaattcactgaagtattgggttgtatgtattaaatacttttaaacaggtcttaattttcctctgttcatgtaaagctacccaatcggtacaaccaacaatccatctaaaaacatttaacaaaagtacaattgattaactttacttaccaatatggtttaattatcttccttacatccttacaatgccagttgtttaaaagttctcaatgaattatgcatagttgtatgttgtaaatgaattcggtttaatatagtttttaaaacttgtcatttttaagttatggtaatatataactgtgttttgacacattatttaaaatatgtggctaagaaataacagaatttaaattttaatggggcaagtaaaaaaaaaaaatattcaattggccattccaaaatatcctttgtgttttgtcctgtaaaagtcagaaatttcattcataatggtcttaaaaaaggccttaaatttgacttggggaaacctgcagaaaccctgcagtagttgttagttagttagtaataagtagagtagaagaaagaagaagctgcaattgtgatactactgtacagttcatactgtggttaggggtctgtaatcatcacagttgcatttacagttcttgatcaaacccattaaaacagtaatctactgaaatattatatatatatatatatatatatatatatatatatatatttatatttatatatatatttttttttattttttttttttagcacatttaattcagtgtcaagtgatctttcagaaatcattcttatatgctgatttggtgctattgattaaaccagaatgtatcagcattcatatgttcaaaagagctgatttatttaagtttaattattaaactaattattacatcattgctaaaactaattcttttataaaattggactgacatttgaatctgattcatcaatatttcagaaaataaagttgtaatgtagctaaataaattcacaaaaccctagttttacactgaagcagaaacagacatgcactttacactccatacatggagtattttgggtctacagtctaattatacagccaaagaaagaagacataaagagtctcatataaaagctgtagataattataggtatgacacaaacactgccagatgaaatgggcttaagtcagaagcattttcttccctttctaatattcccactctcctgtttcacatccttccttcctcctgtgcctgccctttcctccgcctacccttcccgttcgtttccttcattccaacctccattcctgttttggaaaaagtcgtccagacaccagtctaatgtggttcatgaaccctctgaggtccatacgatacttcatttggcacaactaccgctggctgatcctgaaggctctggctctgctgctgctccttctcctcgttgggctcttcctctactctattcctggatacctggtcaagaaactcctaggggcttgaggagaaatgggaagaccactggtagcccattctctgtgcctttgttttctttgcttgctgtcttttcagcttttcacagcttttctgagtatatctgtattcttgttactcataccatttttaaaggcccacgatatggatctgagggattgtgggggattcgttgttttccatttagtcacccctctttcatcccatctgttttttaatgcatatctgtgtgtcattttgtgtctcaggtctttgtgcttgtcatttgcctatggttgtctgtttggggctaaagacttgcattttttattatggatttttgagatttgtcattgactgtctgctaatgtgctttctgaacttacatctgttgcctgatctgttcttttactgctaaacccactttaaatttacagtatcatgcaaatatgtggtagtcctaggtgaatgtttttactcaccctcatgtcgttgctaacccgattgacgttttattcttctgtgactcacagtaatcagaagagaatgtcaaagataactttttttgggttgtttaaaagtggacaagctcaaaatatttccaaccctgttttacctgatttaaatgttgtacacttcagtctgacaacagtgcaaatggacaacaaatacaaactggatacctctacatgcaggtctgaaatggtttgagcttgccgactttcaatgactttcagaggttaggttggccacaaaagaccacctactctctgtcaactgacctaatcccctgtgttgtgttaattgattgattgattttatttgacaattttaagaaaaatatacaaacaagtccaattagactaattcataaatactgtattttaaaaactgtcatggatgaaaaaaaaacacatgcttatttccattgtggtccttaatactcttaaaaaatgaacaagcaaatcataaatggagtgcaaacatcatcagctcagcaactcactacaacaaaatcctcaacttcaatcataaaacaacaattttttaatttcccttctaaaaacactctcaaatttaatctctttcaaatttctaggcaattcattttaggcaacgtagttagtgcacaagtgtttcactcttaaatctacaatgataaatatccctgttactcgctcttgtagaatgacagtgtacctcactaactaaaacataataatcaataaaataacttaactttaaaaaaatacttttactacaattttcattatttaaatgggaatttgtgttgaaaattcaataccatctttggtgttttcagtcaaaattgtctggcctttgaatatttgcttacaaactgtttgtaatgttatgttatatcatcaccacatactggattgaactgattgtctgattgatgtatacttgagtttgagtttttaggtgatgaattcattcttagtggataatgtgagattttaattcattttcaaatattttctaagtgatgtttaacagagcaaggaaaatgtttacagtatttcctttcattttttcttctggagaaagtctttatttcttttagttttgctggactagctggacatatagtttcaagtagtcttgaacaccttgataagttgcatacactgtgcttgattcggattggagcaaaactgtgaagggctgcggccctctaggaatcgagtttgagacctatgctgtacagcatgtgaactctcctattcacttcaatggccagtcgctaagctcagaccaatgagatctgggatcctttagttccaataggaaataaaaaaaacctgttctaattgaaaaaaaaaatagctgagaacaaaaaaaaaaattcaaaatgtgctatatttggtttttccaccacaagtgtaacaagctataaattaaaaagtgattcaaaacactttaggagattgttaaataatgtgctaaccagagaagatttcaactttgccgtctgtattctttagtttaatggcaaaatatgacaaaaaagcacaacttcctcctacagtcctgattctaacacagacccacaacagaaatgaaaatggctgctcttcatattgtttatatatgttgtctcgattcaaatttatttgaaaatttctaaatgtcattattggtctttagtggacaaagttagttcatttgtgttcagcagaagaaaataagtcataaaggtaaaaaaaaaaaatactataaaatttttaaaactatcaaatttgatcaagtgttcatacaatgaatgtcgatgggaatgttgttcggatcccatttaaacttcctttatgaacataaaacattttttcaatatcttatgtggtcagcagcagatgaaagttagtcataatggtttgaaactacattttttggggtgcactatgccattaagagcccgtgggctaaagttttcccatggtaaagtcccccccaaccaatcagagaagaaatggaaaaatgatgggtttgattggggtgaatccctcaattagagatcgccatttctaattttacacattcttttgtgtatttgtttaattgcagagctacaaaaaaaactgaaattaaatgtatcaattaaatgtgaatttatcagattttaaagggtcatgaatagcctaaagcactttttttttagatgttgacagatattttgccccccattgaactccattgtgttataaatgagattattataatcatttaatcattattgaaatgattaaagtattatatatatatataatttaaatatttaaatatttttaaattaggaagttaccatggcaactttaatggaacacagtttggtatatttagctttggctcaccaccctcagtcaagtttggtttttgacccttcataagaaaaaaatttgggcacccctgctttaagagatcaggataccatcatcctactaaccactaacatatatattacctctcttcctccatcttccatgtttcaccttccaactcaccacctcctacctaccttcatcacctcttcacatccaataacagccggcccgacaccaccttcctgtggtttctgagcccactgaaggccatccgctacctgatatgcaaccgctacaagtggctcatcatcaagattgtgttggctctgctgctgctgatcatggtgggcctgtttctctacagcatgccaggctatctggtcaagaagctgctcggggcctaaagagagatctgaaacgttagtttgagagattctgatttctcaagcggcccatttcttatttttggttagaatttaaagcacttctttaacttttagaatttagcgtacctcatgttaagcgcaacgtatcaaatatctggactttttaggtatcggtttgcatgtattacccagaaagatcaattatcttgtttgtctttgtatatttaaagaataacaactcatagggagaaaagtaaagcagcaaagtgtctatttttggtacgaaattgaataagctggttgagcattttcacgatttattcatatgaatgcattcagattcaatattttgtcgttttggtctagatgtgtttgtgttgctgctaaaagcacaataagcatgcaaatttgtcttaagaaagatgacttgttcatcagtagctgcagtctgaaaaaaaaatcatgatagggttgcaggcctcgtatagagtatgtaatttgattacattttgccttgatgtttgcactttcagtccctgacacaaatcttctgtactccataatgtttatcctttatagaaacacacagacacaagtagaggaatgatgtctcatttgacattttcaatttaaacaatacgagaatgctctttcttatactccatgctgtggattgtgcttgcggtgtacactagtttgcttgccgtttactattggtctatttaatgaatggtaaactaaccatggatatgtttgcactgattttggcttgtttatataaaagagtgtatttttaattcttgtttacaagtgtgcaatatggattgatttatttatttttgtcagtatgatgacataataaaatgaactcattgaagtaaaaggactgaacgtgattcttgtttctatagtttgagtatgcatgtgtgagagagtttataaccttgttctttttcacacagtcgtccaactaccagcctgtcgtggctgttgagtccgattcgggtgaccagcataatgtgttggcggcagtataagttggtcacagtggtgactctgctcatcataaccgggctgatctttttgggcctcctgttcttttctctgccttcagctttcatgcagaagctcttcaacatctctggatagtcttctgatgccagcacctaatgcccagtcaatatttatcatttatgatttaatggatttaaataaaaggttacatatgaa

SEQ ID NO: 17 - DNA, 103176 bp, Macaca mulatta
  source 1..103176: mol_type = genomic DNA
atcggaggggggtcgggaggaggaggaggaggcagcagcagagaagagagaggcgtgtgagccgcgctccaccagctagctccttcctgctgctcctgcctggcagtgccaggcagctcacaccagcatggccctgctcatccacctcaagacggtctcggagctgcggggcaggggagaccggatcgccaaagtgactttccgaggtagggaagcccctgtcttagagggacgccagctctgagagttggcccggcgcattctctggaggtggccggggatgggacagggctgggaggatgagtgggaaaagttctagcagggcctgggacaatgagccttttcacaggtagtcatctgcctgggactgactggccattgtgatttctggaaaatctcagttccctgtgcttccatgcctgtgtctccttgcgcttgccaacatgccagtgcccaggcagggtgcagagccctctgcctggggaggcagaagtgaggaccacatccctgagctcagggagacccaggaccccctcttcctctctctccctctcctgcaggttgatttccttgagcacagggtaggggccaggtctggagcctgggacacccagggtggccgggagaaaccaggcagccagtagctccctgggccccagagtgatgggggacactgttggcttctcttacatctattcatgggtggggaccctaggaaaccctcacctctcttctgtctggtcttttctcatccttttcactcatgttttcagtgaccatttatcatgatctactgtgtcccaaggataggggtagaaacacagagctgagcccaacccagccccagccccaaggagcctgcatctgttgggcaggcgtgggacaagcagcacaggtatgtgagacagagggtgggggtgagtgcagcatgcatgctacagaagcagcaccctcacccaggctggtgactggtggtcagggaaggcttcccagaggaagcaacactcagttgatacccgagggaccagcaggagggagctaggagaggaggtgaggactaagtagacaggggaaacggtgtgcccagagctgagaggagctgaaactctggaaccgaaagaggttccatgtgtctacagcccagagagtatgcaggagcggaggccagagagccaggcagggcaaggatgcgaggctggacctgaccccgtggacagcggagcccctgagcattttaagtggggaaaggcagggccaggctgactgtgtccttcaccaacccacctctgcctcttcatgtggtcgctccccagccctgggggttggcggtgcttctcactagacacggccccttctcccaagagaggggtctgagagtagtgaagagggggcagagaggaccccaccatactaaagagcgaagtgaaccttggggcccaagctggacacatgtctgcacctctgctggaagggactggagaggccattggcagaacattccagcaagagccctggggcacccacatcacctactcagaggccctgggatgcccacactgcagcttgtgttcatagggacaggcaggggtggaggtgatggcagtggccctgccagcaggaggaggtcaggcagaagggagagggaggtgtgggctgggctgccttttgcctcccaccccaacccactgactgctttctctgcagcaccctggacctccctctgtgtgccacctgctggctcatgctggctttagaaaaagcaaatgtgtcctttcacatgtgaaatgtggccctgagctccatgggcagcatagtgtggggtagttaagctacaggttgccgtcctgctgcagctatgctgagacagtccagtctgcaccggacaggcccatttgcaggcagagaaaccaagactcaggggtagaacactgtgcgtggcattcacagaggggctgaggcacggtggccccagctctcaggatcccatcctgagtactcaatcctgcaagctctttatctcctcctgggccacctgggaggcagcaccttgtctatctgacacccatcttctccttggagcagcgaagggctgggcctttagcctcactcaccaaacaggaattagtctatttgcaacccttgctctctggactgagtggagaaatagtttccaagctccacatcagcaggaggtggccatgggcagagctcccggggaagggggctgggcagcaggaataggcagatgacaagcagtttccagaaagttccttttttacaaccagagatgcctcagccactcacctgcagcgtccagcagttgacagctgtaggcatcccaaaagaccaacaccgaccacaattcagagggaatggacccactctacgacgttccgcagcatctcccagcacacgcaaccactgggggccgagcaggtcctctgcagggggaaacaagaaactggtaaacatgcagaggcagacactggccccaggctccccaaggcttttgagtgaagctcaatgctggggtgggtaagggagcccttggtgagttgtgcccattggcagaggccccaggtaggccagagcaggttgaaatacggcttgaccttctgtgctgtgccatccaggacactaaggaaagagccctgctgggctatcatggaaaaagttctggatatggagtcagaagccctagattctacctgggttctgccacttacttcacccctctgaccctcagtttccttatctgtgaaatgggcatgataataacacgcacctcactagactgcttcagagaaaccataggtatggaagagtttgagggaagagtattcatacagccgatgtgtgtgtgaggcagccattcccgttctccttggcagcagctattggcccctgacatatcttctctccagtccagccttctccccctgtcggccaggagtgagcagagggccccacgtgagatataaagggaagaggagaacacatctgatgggttccagtctgtgccaggagcaggcagattgggcctggcctctgctctataggagcctctgctgagatgttgcgcaggaacccaggcaggcagacccccgacactcctgttctcatctggctgggcgtgcaccagctttgcctgtggccacctcttttcccactgccctcaggtcagtcggccccacgctcaggttcctcagtgctcccagccagttctatatctagctcttagctcttactgcccctggctgctcctaagctggtcctgccctgttagtgcatttcctgaacatgctgatatttgtgcacaggcctgggaccctgaggtgaaggggccaggctggccttccaggagttacaatcccattgggtcagacaggagatagggagtcctgagtgaatctccattgtgcctgcaggccacagggttcagctgggtttcccattaacaaaatggagacagtgatcctcatttagctcagaggcctacagttcccagcagtaatcaggagtgggctgtgtgagaaggagccatcttgaccacaggttgctactcaaagagaggaagtattagcttcaggtatttcctttatcaacacctgagatggttccctacgtcaatgacagagccacagaacgcagggtgtgaggggtcctgaagttcttctagcccaaccttctgtccagtgctgagccccaaggctgagggacctggactgtcagggaaccaactgtcagggaaccaagtgacagactgtccagggccagccctgatgtctcccttctctttccatcccctgagccttctcgccaagacatgaggtttggggattttctgtgtgagacaagaacgtctgaaggctggacctggcttccacataatcccccgtggctgggaattggcatgaaggtttgcagggcatccacctccaccttttcattcctacttctcttcccaccctacccctgattcccaccctgctatgttcccactacattcaacttccagccattcccaaaagataccacacccttttacacctccaagccttgagacatggatcatgtttcttctgcctggaatgaccaccctccaccttgagaaagcccattaattctgctcatccttcaaggcccagctcatatgccacctcctccatgaagccttctcctcctctagcagtacactgcacacattcttcctactgctctgccacagtacattgcatttcagaaactggccacacctctgcatgctgccctaacttttgagcatcttcaagacagacatcagacacggtttctgtctttgcggaattcactgtgtcatgggtttgagttcttccactgtggcactgccactctttggctccatttccccagctgtgagctcccaccccagaactttctatccaaggaggatcaagggactggaagaggcctcaagggccaagaaccaaaaaccctggctcttactccttctatcaactttcctagcccagagaatcttccagggctccaaaggggcctaacaaaatttttttttttttttagacggagtctcgctctgtcaccaggctggagtgcagtgatgtgatctcggctcactgcaacctccgcctcctgggttcaagcgattcttctgcctcagcctctggagtagctgggactacgggtgcccgccaccatgcccgactaatttttgtatttttagtagagacggtgtttcaccatatttcccagccaggtctgtaactcctgacctcatgatctacccgccttggcctcccaaagtgctgggactacaggcgtgagccactgcgcctggtcaggcctcacaaatattagcaagctcagctccagcccacaggtgggaagcgagagggattgcatgtgtaagccagaatgagttaggggaagacggaggaaggagaaaaggcagatgggaagggaggtgggagcagactctgagttggcccctggagcccagaagggaggcaggagtttttattgagcaggggaaatggtcagtatttaagaagccactgaaggatggtagctcattgacaggatcaaaagccgtgaaagggccaggcatggtggctcatgcctctttccgaaccttactgcgaccacacgtggggcaggatctcactgtctgacagaggagaagaaacacacacagaggtgaaatgagtgcagcatacaggagggccaggggtgggggtaaatcacaataatgtttagaggatgacagcttacttagagctacagagaccagggaataggagcaggaagaggagcaggaggaagtgcctaagctgggtcttgaaaaactgcccctgtttgcccccatggagatgcaggaagtgaggaattggtgatgaaggaaggtgaagtcattctgggtgagggactgaccagaccagaggctagaggaggggaattgcagccaagttccatgtcggggaaatcacaccatgtagctggagcagaggctataggaagtggtagagggagaccagctaggaaaggagcagtgggcctgctgagtgattgtacagggaagggttgcagctgaggcactggggacaagatttccccctactgttggctgcaggcgccacctccgactccacgttagatttattttccccagtaaaatgagggagcgctccctcttgatgaaaaatacagctactatttggaaacttatctgccgcccctgatgaaggaggcagaatacccagtgcacccacccctgagatgctcctgcaatgcctaggcctgtctgtgggctgtagtccagcctagcaccccctctcttggagaatgtggggtaggcattgtccctgctgaaggcggcaatagaggggacccttacaacgatcttggcagcctgtggctggctgtggacatagccctgtgctttgcccctcctccctcccccagagcaagccattgcacaccagcgaacagcagacagagcacacagaaaattccccaggcttctcctgctttgataggaagagtgtgctttcatgtaatgaaaatgattgtaaaactgtcttctgctgcaaaagccctcaggaaaatgctgctgggaatgtgctgagaacagacttgcaaatcatttctctgaattgggaagtcttggttatcttagccacctttaccgaccatgtgaaagccacatctctcccacccactcccatccctgggtctcattttattttatttttttttctgtcgcccaggctggactgcagtgacacaatcatggttcactgtaacctcaacctcctgggttcaggcgatgctcccacctcagcctcctgagtagctgggactacaggcacacaccaccatgctcagctaatttttgtatttttagtagggatggggtttcaccatattgcccaggctggtcttgaactcctgctcaagtgatctgcctgcctcagccctcccaaagtgctgggattataggtgtaagtcactgcacccggccttatcttcttttttttttttaacttttatatatatgttaaaaaaaaaaaccttaaatatatacaagagtggggagaacagtatcatggccctatgttgtcccatccaattttagctatcatcaattcacggccaatcttgcttcatttgcatcccatgatcctacttccccaccccaaattattttgaagaaaatcccaaaccccataccattccatctgtaaatattcagtacatagctataaaagataagaactcaaataaatatcacatactttgtcattttaaagaaattaataacaattccttagtactatcaactaatcaggcagtgatcaaattcctaattgtctcatcaatgtcataatttttttccaatttattaaaatcttcattttaacatgttttgtaaatcaggcatttaatcatttattcactgattctgttgaagggcagccatgtgccaggcactgggggacagtggggaatgagacagacgtggctcctgtcctcaaagggggaagatgatggctgcacccatcatgaggagcattatgggaagggaggcacaggtgcccaggcagttcgtggcaaggaaatccacttagcccaggaagccaggaagccaccccagtgggtgagccagagtcagttaggggaagaccgaggaaggaggaagggcagatgggaagggaaataggagcaggctcccaggtggcccctaatgcccagaagtgagtcaggagtttttactgaacagtgggaatgggcagtatttaagaagcccttgaaggatcgcagctcgttggcaggaacaaaggccatgaaagggctggatgcggtggcccacgcctgtaatcctagccctttgggaggccaaggctaggggatcacttgaggccaggagttcaagaccagcctggccaacatggtgaaacccccctctactaaaaatacaaaagttatccaagcatggtgggtgcacgcctgtaatcccagctactcaggaggccgaggcaggagaattggttgaacccaggaggcggagcttgcagtgagccaagatcacgccactgcactgcagcctgggcgacagagcaagactccgtctcaaaaaaaaaaaaaaaaaaaaaaaagccatgaaaggctccatcccaggcagaggggctaacactagttaacattagtgcagacttgctggtgtagagatgcatcaggggagtgtggagaggaggctggaaggcagggcatgggggactcagccaaacacagagggtctttggtgtcacactagagacactcttagcaggagaatgggatgctaagatattgttttggagagaatactctagatgtgaggactgtgggcagggatgcttgggaggaagcccagggcaggcggagggcagagagcctcagcaggtgggcatgagagaggaaggagcagcgctgggatcaggggagtgagtgagagggcaggacaagggtacctcaggacaggagtaaattgtggccctggggaccaccgtggacccagggatttggggtactgggccttagttgattctcctctagactcctgccagttgctgacactctgaattctggcaaacatggagacatcagagtgaaaacacctggagccattgccatccaggtgggcgcctcgagggcaggcgccttggctgctttcccagcggcagcatggggcctggcacagaacagacctgacacagaagtgggagcaaggagcaccgcctgtgggtgcaggcgcagtgatcagttagcaacaggggcccccatgcagcctgccatccaggcagcgccaggcagtgatccatttctcttggtgacagccctagaaaaggctcctgagacatggaccatcatgtgatcatttttaccctagacctgtctgaactcatccacctgctagatgctgcctcaacagtcctcgtttctattttattttcttttatttcatagcagaagggctaatctgctgaggtggagatcagttttcacccactggctttttttttttttttttcagccaaagtttaagaaaaagtcaggaaggactgcagtttcaacaatatttttaccctatcggagtaaaagagtcaccctcccattataactcattgtattcccagtgcctgacgcagaaagggtactctacacacttgtggatcactgggaccacaagctctcctgtcacagtaacaggggaatctcggacccagcagttgcttactgtgtgggtggcactgtccaaggctcaaagacaaataccacaggcccttcctgcctcagtgccagggtctgaaaaataggaaccagtgctctcagtcagttgcagggcaaagtcagaatctgagtgaggacctggaagaagggtttgagctgagccagagagatgggatttatcatccctgctcaccccctgcctctcagatgaatccctgacccaagcctaagtttccatagtgtaaacctggatgctagcagggtgggtcaaggggaaatacatgagtggaggtagaaatgatatttgagtacaattgtgtaaaataaaaggttagagttccatggggcctccatttagcagggaaatggggaaaatggaaggggtaacctccagtgtgaggcccagggactctgcagtaccaaagtctggctctgtgagtcattggtgattttcagagagtacactatgtaagaaatgtgaggaatagctgctttcttggacaactctttgaattgaatttctttctgttaccctgccatcaactgtcattataaaattgaaaatgtgtttctcatggggaaaaaaagtgttattacaagagataatcacaaacaactagacaggaaaatcacaccaccgtcaaccaccttgatgtaactggcatttctagaacattacacacccaaaactgaaaaatatacattcttcttaaatgcacctagaacactcaccaagacagaccatatgctgggcaattagacaagtctcaatacatttcaaaagactgaaatcttacagagtgtgttctctgaccatagtgaaattcaactaaaaatcaataataagaagatatctttgaaagttccaaatatttggaaattaatacccttcttaacctatggtcaaagaaggaaagaaaagagaaattatcaaacattttaaactgaattataatgaaaatacaacatattaacatttatcattttaagtacttctagcagaaaagaagtgtgaagttgtaatctaggtttctgctttaaaaaggtaccaaaagaaaagcaaattaaacccaaaccttgaaaacattatgttaaatgaaagaagccagacacaaaagatcacactgtataatctcatttacagtcaggcatcgcttaatgataagagtatgttctgcgaaatgcatcgttaagtgattccgtcattgtgtgaacatcatagagtgtacttacacaaacctagatggtctagccaactacacacctagactatatggtatgacctactgctcccaggccaccaatgtgtacagaatgtaactgtattcaatgctgtaggcaattatagtacaatggtaagtatttgtgtatctaactaaacatagaaaaggtacagtaaatacaatattataatcttatgggaccactgttgtatatgcaagtggtcatctgactgaaacagtgttatgtgatgcaagaatgtatatgaaatgctcagaacagacaaatccatacagacagaggagattcgttgttgtcaagggctgcggggagggagaatggggagtggctgctcacagatgtggagtctccttccagggtgatgaaaatattctggaattaggtagtgggaatgggtgcataaccttgggaatatactaaaaactactgaactgtacgctttagaaggatgactgttatggaatgtgattatatttcaataaataaaaatcaaacatccccgccaaattaaactcaaagggagtataaaaggaaggaaatagaaaatagacaacagagaaatttaacaaagccaaaagttggttctttgaaaaaaattaacaaaatagataaaccctaggaaggcttatcaaaagtaaaaaagcaagaaaacacaaagttccaatttcgggaataaaagagggaatatcatcacattaaaagaaaaataagggaatattacaaataacttatctccataaattctacaactcagatgaaatgaataaatcctttgaaaaacaacttaccaaaactgacataaaaagaaatgggaaatctgaagagcctccatacctattaaagaaattgaatttctaataacaatgatgatgatgacgataaccttcctgccacaaagaaaacttcagatctagattatttcactgccgtattgtagaaaatattttttttttctttttttaagacggagtctcacactgtcgcccaggctggagcgcagtggtgcaacctcagctcactgcaacctgtgtcttcccagttcaagcgattctcctgcctcagcctcccgagtagagtagctgggactacaggcacgtgccaccatgtccggctaatttttgtattttagtaaaggcggagtttcaccatgttggccaggctaatctcgaactcctgacctcaagtgatctgcccacgttggcctccccaaagtgctgggattacaggcatgagccaccacacctgacctgtagaaaacatttaaggggaaacgtaataacaaccttacacaaactctttcagaaaatagagaaggaagagcacatctcaattcattttatattatcaacacctgacaaagaccttacacaataagaaaattacagcccgatatctctcatgaatacagatgtaaaaatccttaacaaaatattagccaactgaatagcaatatatgaaaaggataacacatcatgacaagtgagtattatcccaggaatgcaaggttcatttaaaattagaaaatcaaaatattttaccatattaacacagtaaaggaaaaaattcatgattatatcaatagatacagaaaatgcatttgacaaaattaaacacccattcatgataataactatcagcaaactaccaataaaaagagcttcctcaatctgataaaaaacatccagctaacattatacttaattcagaaatattgaacattaagatcatgagtcaggcaaagttttctactctcaccacttctattcaacactgtactagaattctagccagcacaaggtggcaaggaaaaaaacaactcctattgcttttttttggaaaggaagaagtaaaactttctttattcacagaaaacctaattggttatgtagaaaatcctaaggaatctattaaaaagctactataattaatgagtgaatttagcaagtttttaggatatatgattaatacacaagaaaataaattttaccaaagatgggaaagacttccaccctaaaaacaaaacagaacaaaatgctgagggaaatattaaaaaaaaaaaaaagtgtagaaaatagattatgtttatggactgaagattcagaattgttaagacgacaattctccacaaaatgacctataagctgaacacaatcctgataaaaatcacaacagactattttgtagaaattgaaaacattttaaaatttatatggacatacaaatgatacagaatagctaaagcaaccttgaaaatggagaagagagttgcagtgttcacaccacagctgacccctgaacaacatggatttgaactgcgagggtccacttatatgtggattttcttcttgcctccaccacccctgagacagcaagaccaacccctcctcttcctcagcctacacaacatgaagatcacgaggatgaagacctttatgatgacccatttccacctaaagaatagtaaatatattttctctctctctctttttttttttttttttttgtttgtttttgagacagggttttactctggttgcccaggctggagtacaatggtgtgatctcagctcactgcaacctctgcctcctgtgttcaagcaattctccttcctcagcctcccaagtagctgggattacaagcaagcaccacctcactcagctaatttttgtattcttagtagagacaaggtttcaccatgttggtcaggctggtctcaaactcctgacttcaagtgatccacccgcctcggcctcctaaagtgctgggattacaggcatgagccactgcgcccagccatattttctcttccttatcttttttataacattttattttctctatcttactttattgtaaaaatacagtacataatacacataaaaaatatgtgttaattggctgtttatgttatcattaaggcttctggttaacagtaggctgttagtagctaagtttgggggagtcaaaagttatacacagcttttcaactatatgaggggctggtacctctaatccctatgttgttcaagggtcaactgtatttaattataagtctaactataaagttacaggaatcaagaaagtgtgacattggtctaagaatagacgtatagaccaatggagcagaacacagtgtccagaaataaaccctatacatataaaatcaattgattttcaatcaaagtgttggatatctagaactagatatctatatggagaaaaaatgaacttcaaactcctacctcattccacccacaaaaattaatttaagatggattatagaattaaacatttaaaaactataagcttctagaagaaaatatagaacatctttgttatatttttgggttagacaaaggtttcttaaagaaaaatttaaaaacactaaacataagaaataaatttcactaaaaacttgcatttcttaaaaattggaaactctttggctagtcacagagtaaaaaaaaattgaaaactcctattcattaaaaaatcacatttaagaaggcatgagaaggcaagtcacacacaggaagaaaatattcacatttatctgacaaaggacttgtagccagaacatataaagaacccctacaagtcaataataataagacaaatgatgaaattttttatataggcaaaagacttgaacagacactccatagaataagataaccatatggccaacaaatatgtaaaaatgtgatcaacatcctaattcattagagaaatgaagattaaaattacgaagagatactatttcacatgctctaaaatagctaaaatgtaaaagtctgacagtattcaaatgttgatgaggatgtggaacaactggaaattttttacattgctgataagagtgtgaaatgatacagcagtccctttggaaaactatttggcaattttttcttttcttttcttttttttttttttttgagatgggagtcttgctgtgtcacccaggctggagtgcagtggtgccatttcggctcactgcaacctccgccttccacatttgagcgattctcctgcctcagcctcctgagtagctatgactacaggtgcgcgccaccgtggctggctaaaattttttgtatttttagtagagggggggtttcaccgtgttagccgtgatggtctccatctcctgacctcgtgatccgcccgcctcagcctcccaaagtgctgggattacaggctgagccactgcgcccggccagcaatttcttataaagctaagggtacctatcctgtgacataaccattctgttcttaggaatttcctcaaaagaaataaaattatgtttccacaaaaggactcacatgaatgtttacagcaactttactcatatagcccaaccctggaagcaaccccaaagtttgtcatcaacagagaaatggaccagcaagttgtggtatatgcatacaacaggctattactctacaataaaaatcaatacattacttatatatgcgacaacatggatgaatcacaaaaacattgcatttaccaaaagaagccagacacacaaaaagtacattctgtaggataccatttatatgaagtttaaaacaggcaaactgatctttggtgctagaaatcagagcactggttactagggcactagaaatcgactggaaagggacatgagagaatatgtggagcaaatggaaatgttctatgtcttgattgtgtggcagttatacagggaaatgcatttattaaaactcattgaattttacacttaagatctatgaatgtaagtttcacctagttttaaaaaaagaagagataatcacacctaaaatacctaaaacttgaaaaatattatataagatgaggaaaaaaagttatttctgattacatgctactaaaaataagctgcaaatgtgattcgtaatagaagaagtcatttttatatttagcacgtaacttaaaggtctaaaggagaagcgagctgggcgcagaggctcacgcctataatcccagcactttgggaggccaaggagggaggatcacttaaagtcaggaattcgagatccaagtggccacagggtgaaaccctgtctctactaaaaatacaaaaaaagttagccaggcgtggtggcgcacgcctgtaattccagctacttgggaggctgaggcaggagaatggcttgaaccgaggaggtggaggttgcagtgagcggagatcacgacattgcactccagcctgggtgacggagcaagtctctgtctcaaaaataaataaataaataaataaataaataaataaataaataaaaggagaaaccagactatttagtagactgagaatagctatttcttattgagggacaaacttcaccagatgctattgtaagcattattatttccttcattttaggggtgaggaaaccagggcaaagagaagttaattagcttcatccagggtatgctaactaggaagaggtagctgggatttgaactcagggactctggtccaagagccttaacctctatcctatgctccctcatgcttgtaagggacttgatgctttacttagactttcccacaacagtttcttgtcatcctcgcgatggtcccaagacataggctggtccaggataatgacccccagcttacaactgatgactctgagaccccaaggggttggaaggccagctcccaggcccccagcccatgggccgttgtgccaggctgcacacctgagtgggcctggctctttttcctgcacgcaggggtgcgtgggccctgcttcctggtgctccatgggagtatctggccttcaaaaggaacagattgatctgaagtggggagagaaaaaatacagcaggaccaccactcagagagccgctgtagaggaagagcgggagaggagacgccaggacatgggagcgtcacgggagagaatgggactgtttgctgagctctgtacagcccagcccaggcagcacatacaacaaggctttgatgattttaaataacgcgaggaaatagcagctccaggtttgagtcaccagcagagttttactctgtttctcagttcacacagggacaacacaatggcaggcactgcgggagacaggccagtgggctggccctggcaaaatcatgaattcgttgaaaacagtctcaggaaccttctccttcccccttcagatggcccaccacctcaccctctgcccttttgggaccccagcccctctccagtcttgcttccacaggctgctccctgagggcagaccatttttgcttttcccttcgccgtcaggactccccgtcctgtgtccagctccttggggctccattctctgctccatgcttcaaacatttccttacactgttctctgtgcctggatttcccgccttctccttgctccccagtctgtctgaatatccagatttttctcgtcttccagtgtcaatgcctgtgcctctacaatgcctccttaatccgttatgttgagagtcattgctcctttttctgggttttcactttatttacactttttgcatgccaatgaacaaaattctgccttatatacatcagcagaattttccatgtctgacatatctccctctggattgtaaataaatgctcttaaaggcatcgttcagattcgaatggtctttgtacaactcccctctgtgaaggccaaatggcacacaagccaggagcaagaaagccccggttgcctgtggaaatgaatgaacatacatgggctggcagccatgtgcctgcatacctgccttttctcagatgcgtggccctagcagggtaagctgtctggaagagggagctattttgtgcagatggaatattttgtccccttaaatcaagtcccatgaaaggccagcatgccatcctgcttctgaaacaagcactgagctcgtctccatttaggagaagagctgccgcgtggatatttttaagtggtgaatggagaaatgggtatatctgataccatggcgcttgttacactttgagcagactctgctattcatactccatctattgactcagggaggagtttatttcaaaccaaacagctcagctatcccagaagcagctgcctcagaaggaaggaggatgctgtcctattttccccatctaacctccttctcactcaatccacaacagcctttccatgtaaagaagaggctattttctttcaagctttattctccatcttctctgtggcaagaaaggtgattggatattgggatttttaatggttttgtctgaaagccatttaaaatgaagctggaatgtcaacaagactgacgttgaatggagtagatgttaagtggaaatgaacttgaaacaagagatggagttagtcattcccctgatcacttggaacagatgatggaggtcccctggctctgctccagggaacagaacagaaccacttgaatactgccagccactgtttgtacataccctcctgaaatggctcatccaaaatgctgaaggacattttgttttcttaataatttggcctttccactgtttctatatgattgatgtgtttcagcaaaccttttttaaaaaagaatagctagaggtaaatttagctcatcctgtttgaaaatattcaccatctctaaatccccagggcctaaatcaatgaggttttagcacatttcgacacagagccctgatgtataaattctgcagtggctaatttcacatattttacttcctctctaacaaagctatggacaaatgcacaagcaggggagggtttgagccttggtgcttcctgtagatgatgtgaatctgacaccatcttggagcagggcccctccccaacgtctcccaatcctctgctgggttgctcggtttttcactccaagagaccctggaggacagctatatctgaggctcattaaaatcttctaggatgaaaaggtctttgattattcagagcagcaggtctttaggtgaaggccttatacacaaacatgctcacctgattctcaatttatattgtgtgttacctgtggggaaaattaaaaactcaaacctcaggcactttccctctcctcccttggttgcccgggggcttgctgttgagatatttcttgttgattgtttttttttttttatgtccctggctagtgctaaagattatttctttcccatcttgtttacttcacatctcttttctttatagatagcctctgctttgcggcatggctttttgctccttatctcagatgcagccagcccttccccacttacccccaccccaaaacacacacacacgaacacacaccctttcggagtggatccacactccccatttcagtggatctgacatcaacgacccctccattcccagccctccttgtcagaggggagctctgcattgaactaggactagctcctgggtcataaaagctgctgggaccctggagagctcttattaaacagataaggccaccaacgccagaggagagaggtcaattcctggagggaacaagcctgttttgctgagccccgttccttgcccagcccctagacccatcacagggaaggttcagaggacctctgacccctccagtacctccttgtcctggcgccactctagcctggtctcccaggttttctgtagggagaggagcatagtccgctccccccatgccatggtctccaacattgacaacccaaactaacccccaaataggaatggcttcaacctggagagagtccttcaatgaaatggtttatactggtggatatttaaaggtatttgtctttcagctgggtgcggtgactcacacctataatccaagcactttgggaggccgaggtgggcgatcacttgcggccaggagttcgagaccagcctgaccaacatggcgaaaccccatctctactaaaagtaaaaaaactagctaggcacggtggcgcatgcctgtaatcccagctactcgggaggctgagacacgagaatcacttgaacccaggaggcagaggttgcactgagccgagattgcaccaccgcactccagcctgggtgacagagcgagactccatctcaagacaaacaaacaaaaaaaggcatttgtctttcaattactaaaagcaagcatggttactggaaaaaaattcaaattcacatgtatttatttatttatttatttgtctttcagccaggtgtggtggctcgcatcaaagcatgctgctttccgtaccttctcactctccctccccagggataaccactttctttcttttttattttatttatttatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctttaactcatcctatctctaggtttcgcctcacagaaattacagtcccttctcttgtggttccatcccacccctaaaacagtatgtatcctcccttctctgtaccattactgtttcttgtgcaaaattgtgccttggagtatgtactgaatggtgttgcactggaggcctggtgcgatgacccatgcctgtaatcccagcactttgggagaccaaggcgggcgggtcatttgaggtcaagagttccagatgagcctggccaacatggtgaaaccctgtctctactgaaaatacaaaaattagctgggcatggtggcaggcgcctataatcccagctactcaggaggctgaggcaggagaatcacttgaacccaggaggcagaggttgcagtcagccgagatcttgccactacactccagcctggggacagggcgagactccatctcaaaaaaaaaaaaaaaaaaaaaaaaaaaaggtatttcccttgtactagtgccctgttgcttggctcctggcctcccttctagaccatcagctccctgtgggtgggagcttgtgcctttgtcattggtccatcctctattccgaggccccgggacatggcctggaacatcagagactccagcggctacttctcaaagtgaactgaattagctggtgtttcccacacattggagccccttcaacctgccctcgattctctcctgacttatttctccccacatcttgggccagttccaactggactagcaaagagggcagctttccctctgtcctcccatcatgccctactgggtggcatacggatgggggagcctgggatgatgggtgtccatctcatacacgctctacttcccgtgccagtggggaaagtgggggcaggaatagagcccaggaggaaactgccagagaccgtcttctctgctaaggctgacaggaagatggaaaaccatgacagtggtggaaggggaaagcccttgtcccacagggaataactctgggatctgacttggttttggggacctggtttgggcaggagcccctggggtggctgcagaaggaagctgggcttcacagacccccatcagcaggcaggggctacaccctctgtaccaggtttctactcagggcagcagggccgggagttaccaccagagctggggaggctgcagaggaggctgagagatccacgggggaagagcgtggtggagaatagctcctggggtcctcttccacggccactctgaccagcctgggccctctgtgccttaggattcccgttcctaatatggaactcatggcctttgaccggcttccctcacgggactgctgagagggtcagagaagaggccgcatggggactggcctcaccctgggagaactgtgcaagccaggaggtcccatgttgcatgacaagtcaaatgctgtcaggacgactcccaagatgaggaggtctgagcccacgctggtggtatggacaggtctgaccctagaatttatttcctctttccctgcagggcaatccttctactcccgggtcctggagaactgtgaggatgtggctgactttgacgaggtaggaggcccaagaccaccccctccctcagccctgagcccagaggggagcaagcacccttcactgcctcttgtgggcacacactggccccaaatcccaggcgccagcctgctctgagcacctcacctctcagctgcttcctgaaggaggtggtgaggaggggaagagcagccttgcccacctcgacagccctgccaggtctgggcctattattccctgtggagaaagagcccacaggtgctgtagacctgaatgtgagccaccagctgagggcccaacaaggcaggcgagtgttggggacatcgcaaaggccaatctgtgtcagtcctcaagggttgaagagcagggcagccccaggcactgaggtgggagccccggtcaccagggaaacattgtcaagcaccccacctgagtcagggcgccatctccagaccttgaggggaaacatggggaagagaagacagtctggattttcagcaacaactctgggggtgccatgagaaaagacgtgagctgctggtctattgacaacgatttttctcaatcctcactccagctgggctgttgtcacaattttatcagcaaaggagtaggcgacaccatcccacgggagtgtctgggagcggtgagaggacttaacaatgcttccctctccctgcccgtcccctcggcacctggcctgtctgggagccccatccttacacacacataccagttcaagcagcccgcggcctcctcggcctcctcacattctttcatctatttgtttgctgcttccagaatctatattcccctctggctgctgtagtttctccagggttgactttggggtgaggaccagcagccattcatcaccatcttggccaaactggaagctccatggtgaccctcaaatagtgtacccccatcgcctgggcttggctctcctgcttggctctgtgggggctgggaagggccttatggcagactgtacctcttgaggttggctgctggcgttcggctgagcagccaccaggctgacacttggcaccagctgtctccctccctctgaaaccgggccacatgatgtggctgtgtccatcgacccagagctggagacacagggagcaaagcctcgttcctcactcaggctcagacacagccatcaaccgtcgcggcccagcaccacgccctccccaaccactgtggggcgcagttgccactacctccctggtacatccctactgctacgcaagacaggtgaattgctcatttaaagtgaatcactagagctagggaagtttctgtccttaccttctccccctcctggttgtacaatgacctcggtttctaaacccgccaccatctttgtcaaatgggattggtgatgggtgtgaaggtctctgtaaaatgattaacaaaatgaagggttatggtgagagtggaaccatggctgcccactgagacagcagtcatagaggcttcaggcttgccgcattatacacccggtctgctccctcccctccccattttctcagtcagggcactgggctggctgggtgaagattccagcagcctggcccagtttcccatagtcctacctccctgggcttctgcccactaatctaccaggcacagcatctgactccctcctcccaagactcccaggggacatgtcagcccaggcatccagccagggggcaacctgatgccccttccaagggcactgccacccctttccatgcccagcgccccggacacctgagccacaggtatgcatgacattcaaagttaatcaccgtgtccttcctcttcccaactctacccaacccgcctcagggggagagtctgtctctgctggccctgaacaagaggccacattctgagcatctaatgaatgccagcctgggcttgagatactccagagggaggaacctgggctcaacaccctgtgatgatctgtatgggagcttagggatggggtagccagagtccgtgtggagagactggggcggggcagaagccaggcatttatgggaagaagcatgtgactaaggtcagagagcagggcacgcgatggggagaagtggctccgacctggggaaagtgctgcacgcccactggggagacaggcgagtttctggctgtcacaatgaggaacctgctggcatttagtgaggtggggagcaaggatgtaaaatgacttgcaacactcaggccatcccgcacttcccaccagggagccccgtgggaagatggtggcagccccagaagcagccctgagctgcttcctgagccatgccccttccactcaatctctgaaataatccacagatgaaatcaggctcggatggtaactacccttccccaggtgacagagctggaagcggccaagccagggctctgaattcttgcgtagatgagacctaagccctctctggatacagtgatagggcctgactcccaccacctctgcaaggcctgtgtggaagtctctccacgccccctaccgccatttctccccgtgcgaagtggctgcagccctggccaccactggtcagcagtgcacatcccacgaagcaggaaggccaccctcccatcccctgttcaggaagggcccggaggcctgggtcagcccaatcccaaagatagcctggaaccgtaccctggctttaacctctctctctagacccagtgggtaagtcgtaaacttccctggcatctccctgaaagaacctgcctgccagtggttccagaatatcctgggaaagaggccctttcaaatcccccaaaagcctcttgactttccagaaagcctcttctctccgcctgactctgcccagggcctgcaggagccagcttagcgagactcagtggcctgggagtcatgagacctgcaccacagtccttgctgaggaacctctttgggccttgcattccccttctgtaacagagggatatgctccctgctctacctgcccccacgggactgtcacaaggctaaaaaaaatgaaatgacagacaagaaagcaaatgtctctcacagctctactaggtaagggattccaagcaagggaggggcccctcctctgctcaggcatgggtgagaggggctgcagcagctgggcttaggaacctgagtggggaggaggaagccatggaagaaagacaatgctctctacaacaatgggtggaaacagagcctggacatggtgtctcctttcccagaggctggaacctgagctcctacatttaacctacaacaccggaaaagctatggagagacagagaaagacccagcctttgtgccctggggaagcaggagtagccacctttagccagtttgctttggctctaacacaggccctgtgtggaccaggccccaggggagaggccagagtaacaatagtacttggagcaatgataagaactgctgctgtttactgagcacttagtgtgtggcaagatgggttgagagctttacacaagcattagactctctagaacttgctgggctggtcacatcctaggtgataaggagccacaccaggatttaaacccaagtctatctgattccaggacctgtggtcatttgcaaagtagacaagattcagccctgccctcaaggggctcagtctggtgggcagatggacccactaccaacaaggagggaccctgggccttctgagcccagaggaggaagaggtcaccagcctgggggatgacagggcaggggagtttggcattatctgcccctttctgcttgtccctggaagtcatgggctgttacgtcctggaggccagaaacgcacctgtcttgttcatcattggcctggcacccagcatggagctcagaaaatgttgccgagtgaaagaatgaacaaaacagtgatattcactaggactggcacctgtcaccacaggtctgtgcccagaccaagtgggctcagcagggctagtggtacatcaagccctttgctgtggcctggatagaaaggaagcagtcaaggcacagacgagatcacctaaggggactttagatcaccttgatctctaaggttagagatcatctagtttaaccctcttgtcttgcacttgaagaaacaggtcttagaatggggaagagaattgcccaagaagaccagctgagatctgagatcctacatttaacgtacaactctgaagaagctggggaaagagacagagacaaagacagaaacagagagagagacagagagagactcagcctttgtgtcctgggaaagtgaaaaagccacactagggagactgagcccaggtctttaagctcgcaaatctgtctctttcccacgatactctaaagcagcagtccccaactttctggcaccagggaccggtttcatggaagacaatttttccacagactgggatggtggtggccgggggtgatttggggatgaaactgttcctcttcagaacatcaggcattaggttcttttagggagtgcacagcctagatccctggcatgtgcagttcacagtggggttcacattcctatcggaatcaaatgctgtccctgatctgacattaggtggaactcaggcgagaatactcgctcactcgccgctcacctcttgctgtgcggctccgttcctaacaggccatggactggtaccggtccatggcccggggtttggggacccctgctctaaagctttgtagtgcatctcaatattttcccccaaacctacaaccctgtccctttaaggatgctaccttgctgatttaggatggttccaggcccagtcaggggccaagctggacataatccaggtcattctccaaagtgcatcagggaaaccttttctgcagagtcctagatcactggggctgataggatgcagaaccttgtgccctggccagcaccagccaggtcagggctaagcctagaccagaaaactgggtcaggattcagcactcccagggctcctgagaccgcccccgcaacagaggccctctttccctccctatctgtactacctaccgtcttgcttctgtcaacagtcttatcccaggctgctattccgggtcagtgtctgtctccagaactatccagtactatccccaggactgagaaacaacctgcatccctgtgctctgcacagcgtcatgcacagagcctggcacacagcaagtactcggcaaatgttcgcccccagcacggggcttgctggctcgtgacatcttgagtgactatgtttggcttaactgcccagcagtaccaggcttcaggagagggttcagtgtagtggattaagccctaaggcagaactccagactaagcattctgagacttgaatttgaatcttgcctctgccaccaagcagccttgtgcccctgggcaactctgctttcccacttgtaaaaggagcacatctttgccatgttgctgtgagtttggttatgggtaaaaggtgctctggaagtactaagtgctacccagatgaaattcttccttcagaagccctttccttcaatcttttttttttttttttttttttttgaggcggagtcttgctctgtcacccaggctggagtgcagtggcgccatcttggctcactgcaacctctgccttctgggttcaagcgattctcctgcctcagcctcccaagtagctgatattacagatatgcaccacccacccggctaatttttgtattttagtagaggcagggttttaccatgttggccaggctagtctcaaactcctgacctcaaatgatctgcccacctcggcctcccaaaatgctgggattgcaggtatgagccactgcacccagccccctttccttcaatctagtagctcataaattcaatggcagagtcaggagaggagtgtggctcccaaaccctcaaagtcctcatctcgtcttgctgtgttctcagcatgtcaccccaaatggaggaaaggacataaccacaaaaatgaggagacaatgaaaactgaaattaggaagagaagaagcagtgaaagagacatgtgaaatccacaggccgaggcagaaaaggaaagtgatgggggcgagggggagggaggtggcatgacagggagacgggacagctgcagacctgcacagagttcccactgggaaaatctaaaccaaaagcgttctgcagtgctgtgtcgcttatgactgctgtcacctgtgagatctcattcaattctctcaatagccctctaaggtagatattgtcaccccccatttcacagatggggaagctgaggcacagctagtgagtggcagagccagggctagaactcaagtctcctgactcaaacttagagttcctacaacaccacggagactcccagtctgcatgagatacaagcctcaatgttgtcagaagaacaaaaagaagcaaagggtgggcatgtcctttggagctctgtaaggtacccagagctcacagacgctgcctgagcaaaataaggtgtcagcaatgggagatggggctggcaatgctgtctgggcacagcaagggggtctctgggtgctgggaaagggaatccccacctctttcagggagctgtggaggagccgttgaaaagttttaacaaaggagagatgataagagaggaaaattcaacccaaaaagtctccttcttacagcccatgcctctgcttgtagggaggccaaatgggagaaacccccagtcccagaccctgagtcacttccctctagccgggaggcccatcaccctccgaggccccacactgatgccaggaccccacctagaggtgccggcttgacccgtctctaggcctgggccttgggatttttaaaagcttctggaatggattccaattccagttcttccagatgaagaacccctaagagagacagagggagacagagacaaaggaagagatagagacagagagagaaactgatgaaagagaaaatggatgtggtgaggagaagaaagcacaggaacgacgcgggagggtaggaaaagagaaatgaggggaaagcctcttgtgggtggaaaatgtgggagggagacaggggaggaaagagaggtatctgtaaagcacggagcaagtcagagactgaagaagctgctgtgattcagtgaggaccctgtcttctccctcgcccagaaagcctccaagaagaactttcccctctgacgtcttcagggactgcccagacctggctgatgagttcctgaaagggcacctgagccacacacctacacacgcttccctgattattctcatctgcagtcaggggcccttctggaagctccctctctcctggaccctccctgacacccaactctcactcaacaaactggtccttgccccccagccaggcagtctccctccccaggtcccttagcctcagcctccggccaccattcaacacccgccatccatttcacagggccatctccaaggtcatgtcctttattcctgatctttctctccttccaatgccaaaatcccacccacagaccctcagggggttgaatcactcctccccgcttcatcaccagtaaaccgaatctcggcggctcctgcggccccccactcccacacagcactgtgactgatgagctgggccttcctgggctgctttatttccctgcagccccataaaagcagcttcattaagaaaaccacacactgctgagctgccagaggcatccagaagctggagccgcagccgctgaatgaggcctgtgggctgggctgcctccacttcctgggcccctcagcccacccttctgccctgtgcccacctcgcctttaaagccctccctaggccctgctcagaaccctccccactccaccctgcagaccccctccccctcctctgcttcttcctccctcttatgccaaggccgggtcctccctgggacttagccagtcctgaagggagatgtcacaaaggctgttttcctgaaacaggccctgcccacactgggcagtgacctgcgggctggcccagtgtgcccaagccctctgaatccccaggctgggagaaggaatctcagctttggaaatggcaaacatgcagggtgggctctcagaagcctccttcccagggcctgctcagccaccaacggagtgtccgaatcacgcagctgctctgaggccaagttccttgtttatagagcacagaagccactacctgcctctcgggccatcggaaagactaaatgaatgaatgcacatagagcattcagacccttgcatgagaaaaagttccccagaaatggcagctattattactattattatttattattggcctattgagcagtctgaatttggtagggtataaaaatggagctaaaaaataaaagtcacttgtcttccacccgatctgtcaaaatcctccctgacacggtctctccacagcgtcttgagcagacctcagcgctgtctggtcctgtccagaagggcttcctactccagtctggcatcctattcacccctggccatcccccttccctcatgcttgtggctcaggacatggagtgggacagggacccctgctgaggccctccacatcctcccctggtgggcagcccatggaaaaagtgtcattagatcactcgaccccacttggccaatggagcgcaactcgaagacttgccacagccaacaggctgggctccttgccctgcagtgctccatgggcctcctgccagtccacgccctacagatgccactggggatttgcatgccgtgctgcccttcttgccggtacctaatcgccatgagctgtttccccaagaagcaccacaaaaacactacgcccaggacagaattcttcccacttttcccttgcccagtcttctgtcccatcccaggaaggtgggctgggtgatggttggaggtaacagggcctttgaggaagccctgggaagatgtccggctctgcccattggcagctttttacagaatggggcactaggccactttagcctcttttttgagcccttgttgccatttctagggcaccaggaaaaatcccaatcaaattcctactcatcactaacattaagttagggaggaagcaacacagaagtggtaagggtgaatccagaaacagtgagctggggacaggctgtgggcctgaccccaggaacactaatcagctcaaacctgtccctgatgttaccattggcagaggagtggtctgaactcaacataggagtctggggcagagctcgcaccagtcagggtgatcctgatgggagagacctggaagctcacagctccattcagcacccgccaaaaactaggctcacacccacgatccttgctgtctccctggggcccgaccaccaccctggttgcaccgccttctcccaagccccctcaggaactaggaggccatggaagcagcactgtgtagggagtcaaaagtcctggtaggtccagactcttcacctaccacatgaccttgggcaggtcctccaacatctctgagcaccatctttgaaagaggagtgggcaccaatgccggctctgcaaggtggtcgttggaactaaatgagattccaggtgtcaatgctttgtccctggggagcactgggcccaagtgaggggccattctggctgttggagacccccaacagagattcccttcccacgccccaaggctcctacctgttattgccaccaaagccacagttgttcctctctccccagacgtttcggtggccagtggccagcagcattgacagaaatgagatgctggagattcaggttttcaactacagcaaagtcttcagcaacaagtaagtgtgggctaggcctggaggggctgggaggctgcccttctccttgggctaccgtatgtttggggctgaaaagagggacctacactcccaacctgccctggattgatcttcaaagaccgaagaagtcttgggctggtctttgatccccattttgctccctcatcttgtcgtcagaatcccccagtcctcccagctgctgtcagccaagaacattccaccctcctatcaccccttctgtctccaaccccatcaaagcttcctgtccctttctttaagtctccctcaatgctatgctggggtacagttacccactggagaggtgaaaggtggaggggctgaagatctcctccaagaaacactctgtagccctgaggacaggcttgacagtttggggtggtggtttaggagtcaggcaagcctgatctcagacactcaggtcagtcatctactgtgtgaccctggaaaagttacataacctctctgatttcaatgtgctcatgtgtgaaaaagacaagtatttacctcaaagggcagctgtgagaattaaatgagatagatgttcactcactcattcaacaaatgtttactaagcgctgattgtgtatcaggtactgaactaggtgctgcagagggcgggttgcctaccctcatggagcttgcactctgcaagtgaagtacacctgccgtacgatcattatcactatgaggtgttcaataaaagtagttgttgtccttctctctgggtcacaagaagaattcagaaggatttgaacaggctggaacagtggctaagtactatcttggattcaaaaatgacagccaggtgtggcacacacctgtagtcctaggtacttgggcagataaggtaggaggatcatttgaacccaggaatttgaggctagcctgggcaacatagtgagatcccacctcttttaaaaaagtcggtcgctcttatacaagctggaggtcatggcttaactataacatgtccaaaagatgtggaggtgttagctcactgaggactcagaataactcaacagtgggaggagactacaaagaaaagaagagtaggcttcattctaaattatactaatagaattaaagcacttttgatctaagcaggagagacaaggagtccactgctctgatactggtggcagagaattcctgcaggcaccaccctatagttgccaggaggaaagggactttaagtgttaacttatgacaaatagatgagagcatgaaagggaaaatcatagaggtcatattcatccattcatcaatccattgattcattcatccatccatccatctatccttcctgttattcatccatctgtctatccatttgtctatccatcagttgattcatccatccatcctttctttcatccatccttccatcctttcattcatccattcatcaatccatctctccatccatttatcaattcatttatgcacccgtttatccatatatcaattcatccatccatcctttcatccatcctatccatccattcatccatccatccatccatccatccattcacccatccttcctcccatccattctttcatcaatccatcattccatctttccatccattcatccaccactcatcctttcatcctttcattcatccttccatccactcatccatccattcattcatccttccatctttttttctttttttgagacggagtcttgctctgtggcccacagtggagtgcagtggcctgatctcagctcactgcaacctctgcctccctggttcaagctattatcctgcctcagcctcctgaatagctgggattataggtgcccgccaccatgccagctaatttttgtatttttagtggaaatagggtttcaccacgttggccaggttggtatcgaactcctgacctcaagtgatccacccacctcagcctcccaaatgctgggattacaggcatgagccaccactcctggcccatccttccatctttccagtcaccaatccatctgtctatccattctttcattctttcatccatcctgccatccatcatccttccttccatccattcatccatcctttcattcttccatccattcatccatctatccatccatcttttcatccaaccttgcagtcactcatcaaacatatagtgaacaaatgctttctgccagtcagacactatgctagtcactggagatactgagatgagggatttaggcacagtccctgccactaccctcccagaaagttttttgccacaggaagaggaaagaaaggtgtgtacctagaggcaggatgagggacaggctgctggaagacagcagaccactgaaagatagccagcactctccagccaatgtgctgtcttaggaggcagtgagctccttgccactgggagagggtgagcaaagagtgggccacgttgtagaggggatttctgagtcaggaaagacccgaccacatgggctccaaggagtctctgattctgtggcttttattaggagctttcaaaatctcagctgagtatggagcaagggcatttcaggcctgctagcagggccacagggaggatgtttagggcacaaaggtcttccctttgcctctcatggcatcacaccattcaggcagctgcctttggcacccacaagcaaggttggtgagacactccccactagggggccccaaggtgaagcacagccttcttccctggggtgagatactatgagggtttgtgacctatgaggacaggagaaacaggaacaggtggaaggctcacacacaggccaagtgggtgtgaaagaggaaacagaatcggaagtcaagcaccagggagggcacctgagagcccctgcaggaacccaactgtaggtgccaaagcatccaggagccttacagcttggccagtacaaccctcgctgtgcaggaggggaaaccgagtctcagaggggctcctgagatcacaggggtagacaatggtagagccagggctagaatgtatgtctgttacctcctcttcctaatccaactcccagaaaccaaaatatctgagcagtgatggtggaaaccgagggcatggaagacattgttaaataatttacaatgaaagctgccagcctaaccactgaaatgctggaaacccttgagcccatcaaaagactgctacgaacaaatcagatgtatttgggagattgggaaattgactaccatgcagtgaatatgttgaaagttccagcttctattaggtattttcgtttttgttttgttcggagatggagtctcactctatcccccaagctggagtgcagtggcgtgatctcggctcattgcaatctctgcctccctggttcaagcgattctcctgtctcagcctcccgagtagctgggactacaggtgcacgccaccatgcctggctaatttttgtatttttagtagagacagggtttttgccatgttggccaggctggtctcaaacttggtttcaggtgatccacttgcctcggcctcccaaagtgctggtattacaggtgccagccaccaaacccagcctgtattaggtgttcttaagtgccaataagaaggaagacagaaagggagatagttcctatcctagctctcctcttcttcttccctccctgcccccatccaagagaaggcaggaaaccccacaaggggaggcccagacccggtgaaagaggttctgccatttctgtggaagcctagagaatgcctagggcactgttggctgcggagcggtgatgggaaagaagaggtcccctcgtggaaagcacaggcccaggctgacacaggtcagcttgtgggggtcagagtgggagaaaggtgtttggaatgatatgacattcaagtctccccatcctggcatttgccttggccaggccaggggagcaataaggccactgccctcaacccccacatggcccagctcagaccccaggctccttctcatggggcggctgagtggagggggtctttgggtctgcactgggcttagcaatgagcaaagccatggccactgctagggacagtgcctggcacatagcaggtccctgattattttgtgaaataaaagaatgaataaatgcccccgtggtgttaggggtataccctctgtataccccagggagtgggagagcctttgagagggaatcagagtggcccttcttttctgaaggactgagggcactcaagggtgacactcagcatcacatgactgatggacttggggaaactgagttaaaggaggcatggaggagctgcctgggagagtggggcccagcatgagaaatgagcctgatcccatcactgccatctcagacagagggatttgtcctagaagccgagagcagcttggaaactggcccctcacccagtggttctagaggctgccaggaggcagacatggtatgaagaaaccaggagacctccaggtctgctcggccccatctgaaacaaagacctgtgtccaggaatcttgggcttccccataggaaagaaatgttgggttcagaagattttgtgcatccagctctgcctgtctgggacctctgaggggccatggcctggcctccagcctcctgcctgctgagaatgccaggggccctgaataattcaggagccaggagagcaggagaggccttgaagggcccaggacacctgacacgggctcccaggggaaagtgatgaattattgacaggattctggtgcccagttgccactctattgtggtcagtctgtgggcccacctgggctggaggcctcttcctgccagctaattatgtggggatcctagctctgcccagctgcccagcccctcgtgcccctgtgaggggcaccctctttgccatggtgacccggatggccatgtaaggcaagtagtcagaggacatggagttagccccagctcctttgcctaacagccccagggaaactgaggcccagagaggcctcttgtccagggtcacgcagcagattcaggacagtcaggtcttcaccccaggccttctgacgcccgggccagtgctccttcccacagaacacatggactcacaactccattcccagggaagtgacttggctgtctaaggggcatatgaacccacccttcctcagttgtcctgggccccactctcccaggcagctcctccatgctgacccatgcagaggatcaagaccctactatgtgtgcagccaggatgcacaaaggccagctgcggcaagcagggtcgcctctggggtcaccacaagggctagagccaggggcttccctacctcttcctgtcccagcttcttcccagagaatatcttcagagaacgggctgagggatggcatcctagaagcagtgccagggcctttgttttgaaactattttcatggcaagcactgtgtttttgcttaaatggtatgttacagacctgtagaaagagccaaggtttataaaactgcttttctttatactttacataaggctgagataatatcaattgtccatgtcaaataatataatttttacttttatttgagagaggttggggatgaactgttaggagttaaaaccccccaagccacttctgggagtgtggcaaattgattcctttaatcttgcaagctcctagcgtcccagtcccactctccgggacatagacaagctcttgccgtgcaagactgagcagagcttgaagggtgggggacagcctggttctccccctgaagcccatcctgcaaaggagacccccctgggtgggccctccagatggccagccctgcgcattattagggaggcaggaggggctggcattcgagtgccggtggtgttagaggaatttcacatcatcagtctcctcaccactgtccggtggaagtcggagggctaggacaaggagcccaaaccacaccgctgccagggggtgggtcctgctgagtgagcccacatctgtctgactccagagcccaggctcttcactgtctacactgcttccctttagggatggaattagtcgcatgtggacagggctcggaccagggagtgaagagtgggggatttgcctggaggccagtctcgctcagcacactatgtgattaaagcagtggctgaatggactaccagtgacagccccatcactgtcaccaccacgggagtatctatcagaggcttgaaagcacgtatcagggaggctgtttcagggattcctcctggaagggatgctgggcaaaatctctcaggttcttcccaagtctaaggtctgagactccggcgggttaagcctagaaggcacaagacgcctctctgagcacttgcagggggaatagctccaccctgccccctgggggtgtcttgtcacattgcagcacctccatggatcctggggagctgcctctgctgttcttaggtatctaattctggagaaagatgtgcctgattgccccacgctcaacaggtgcttgataggtcctaggggaatcaaggcatctgaatagccatccacaaagggtaacagtagagcagggattctcaaagtgtctccccagccagcagcttcagcatcacctggaaacttgtcagaaattcacattctcagcccccctcccacccactgaatcagagccctgggggcagggccagtggtgtgaactgaagtccagtggacccagtttggtgacttcgcatttggagcttaaagttggccatggcgggagtatttatacctcggaaaccagcaaaagctacagatcagcacctctcctctcccaccagtgacacattttccagcacatccacagaggaggatatcccagccatgtgtgttttcacaagccctccaggtgattctgttcatgctgaagtttgagaaccactgatttagaacaaaaagaggtgaggctgagaaaagatgagcgtattcttttgtgcccatggtctactgttagaatgtctacatggtacggaagctaaaagtcctcttccctcttcattttataaagaccaaattgagactcaggggcagtggctccagggctcctggccgccagcccagcacttctgtctctggggcactgcctgagctggggagaggtgcatgcagctatggaaggcttccatggggctgctctaagagcccagaagcccagtttggctttagagtgaaggaggggtgtggtcagtttcacccttggggaggtggggcgcgctggtagatggggctctgagctccagaggggagcatttcatatccatccctcagggctgcccctaccgcttcctcccctcacagagacgggaggattttttaaaaatcagtgttcaccctccatagacctcaaggtggtatagacatcaagcacgcctaagtcagaattcatctgattcctcacctcacccagatctggctttaattagctgtgtcctttccccttccgtagcctcaccgtcttcctctataaatctcaagcagcatcagatgatgcccaaggtcccttctagctctcacacaccctggatgcttccctcgcctttgtgccttcagctagatacggtgtgtgtgttctcaaccaccccatgtggaagcacgatgtgaagacgtctctctgagttccccgttctctccaagagcagcaaatgccttctgactgtggagtgcaatggggttgaagtcaactccatcagcatttattgggcacccactgttgttcattatttcagccagcagatattgagatctctagtgtgctagaaatgtcaaacggaggctggaatagaaagcactacccttgccctggagaggctcgcagtttagaggcagcacatgaataacgaccaaccagactgcttcggagtgctggctgtgctgggggctctgataagaacactcgcagatgatctcactcagtcttccaacaacaactctgtgaagtagggcttatcagctcatcttatgagaaaattgagactgagagagtttaaggaagttgcccaggaagcaggtagctcgttagtcaatgtcagagctggattcagacccctgtctctttgacgccaggactgtgctgttaaccaaagcattgtaccgcctctcccctgctgtgcagatccatgggctctgccatcacacaggttcctgccatccaggaacctacagactgcggatgtggaatggatgagtgagtgctgttggtgtgggctggaaacctcggtcatcattagggaagtagaagccggaggagctacttgtccatccaggaacctcaggtccttccccagcctccacactgagcatctggaaacttctctgcaagggctcagctaaacctgggttccatgcactcttccccacattctgtagacatcccctaagggtgctcactgccccttggagctctgccaaagaaatgggcctcccacaaacaaccatccacagtgagacatgctgccctggctgcaaccagccctggctcctaggccacctccagcccagcccagagctgcagcaagccacctcagtcctccctaagcagtcacagctcttgggatatcagtcttgctcctcaccctggtctgttgcatgtaaccaccatgtgccctctgccgtccctaggctcatcgggaccttccgtatggtgctgcagaaggtggtagaggagagccatgtggaggtgactgacacgctgattgatgacaacaatgctatcatcaaggtgggtgtgccccaggaagttcctggacgttcccatatggggccatctgggggtctgttctccctgccccacacatggggtggtctggggaatgcccctcgtgcatggcgaggtgtggtgggaggaggagactcaggtcagactctgctggaacggctcaatctgtggtcatggctggaggccctgtggcatggcagggtctgctgccccacaggaagcacccctgtccttcctacggtgagaatgtacccttccatttggacccagctcaggagtcattaaaggggctcctctcgtcatccaaagaccagactgagccccgctggcactcgagggcatgaccttcactctgtgtatctggctccagtcctccttaggagggcagggacctcatttcctattgtttgtcacatcccagcacttttgcatgagcatgcatgcactagtgacgcacagtccagaggcacctgatacatgttctaacaaagaaggaggcaaccctaccaagacagcctggccccaggctctgctcagattcttcagtcctcttgaactcagccatggccgctcgtgggcagttggcatgatggtgaggaacagggaccctgggtatgaatcttaggtcgctcactaactgtgatttgggcaagctacatatcacctcaaagtgagcacaattatggtatccacctcacaggactattctgaagattaaaggagaatacacagaaagtacttagaacagatatgcacaataaatctataacattgttagctattatttcctgacctcagtttacccatgtataaaatggggctgtgccattgtcccgcaatggggtcctgtgtaatatatgaccctatgtactggccaggagaaacagcctcagaagccaggactgcagccacagggtgctagaaaagaaggaaccgtcttctcccatgagcaggggtgggcagagagggcttcttaaagttaccggggtctcagccaccacagcaaggggagaaggggtgcagaacaaactgcgtatggacacccatgggaaggcgggctgggaggagagcacagaagcctggatgaagagtgtagtgtgggaagtgagatgagagaattagggagtgagcagggatggacagacagcacagcccacaccctggattttcagaatcagacttaagatgtcagcggaggaaagtactcacagatctcctggcccacttgccacccatctctgctacccattgttatgaatgggaacaatgaagtcctggatggggaatggatttggccacggtcagaacgctagtcgacagcagggccagcatggacacccaggacttccaatgccagagaccaccattttcccacaacaacatccttggttccaccaagagggtcacatttgttccacggaaaggacatggggcttagagtcagtcagcctgagctcagatcttcgtagctgtgtgacttaaagcaagtaacttaacgtcctgatatgcgaggtaaggtaggttgcaatgttgaaaagatcaaatgagtggacattaaaattaaagtatcttagcatgatgtctagcacagtgagggttcagaaaatatgtgcacctttcccttccttgggaaatctaagcctgggtgctggagtgtccaagcactgagtgagggccgcctgtctggggcacaggcataagttacctccagaccagtgaggaagggtgatccctgggcactggggggaaactagagctgcgagaaagtaatggccccaggacacagagcaggaagcccagtcatgattctccattgctaagcctgagcctgggttgagtgctctacttttcccagaggaaaaccctagggcagctcccaagattccttccctctccagggtagaaagggtgggtgtgagcctggggcctgggctcctctcctggaggccactttcagctcattctgtcacatttccaacaagccgatttctggcaggtcgcgcttcatgcctgcaggcagcccttgttctgaggagaggaggtgacctgatcatggggatgctaaacgacactctcggttatgtagacagtggactcaggggatgagtccaggctcagttgtcccgggcaggccaggcgcctccacctggagcaccagggaggagtggagccaccagcagcgggacctggagtcagatcccaataagctgactgggtctgcgcaagtcagcctttcagagcctctgttttctcatcagcaaaatagggtagaggggatcataccatcctaacctcctccagtgaggcaagggtgtggaagcgctgtgtaaacaccaccaagcagccatatatacggggtggagatagctgtctccatcccagctgctcaccaccacctccctcccttcagaccagcctgtgcgtggaggtccggtatcaggccaccgatggcacggtgggctcctgggatgatggggacttcctgggagatgagtctcttcaagaggaagagaaggacagccaagagacggatggactgctcccaggctcccggcccagctcccggccccccggagaaaagagcttccggaggtaacaggaagggcccctctggctgcccactgctcccaagacacggggaagaggcctggggcctagtccccttgacaggcctctctaggcctagctgggctcagggtacagggctgagcttctggagagacatccaagaggtgggaagatgtttctatagtcccccacccagtcgtccacccccgagttcactgggcagggagcagggaactcagatcaaactgcaaggccaaggcctccccagaggccctgagggaggtggagctctaacacagggatggggctagatctcctgcctttctcagagaaggggagatgaggataggaggggccctggcctctctggttcaagacccagcagtgtccaccaggtgccaggagcctgacctccaccctggcccagtgaggaggcccaagagagggcgactcttcctgccagagtgaagccaaagatcctggctggaccctggcctttcttcctcttgagaagggagggctcctgggaagaccagagtccaggatcatgccctgcctggctctgtgttgctacaccaccccaggaggttgccttcgtggctgctaagggctcccaggacattgtttcccatggatctgaccaacaggttcggagcgtccctgggtccttcaggacgtcctgccacccacagaccacaggaagctgggtccaggccagttcattccatgtgcactatttttacaaaacagaaaacgcaattgtattactattagagaccaagggttcctaagtcactagaatgacatgggttcctaagtcactagaaatgacatgttaaataccagtaagtcaagggtgcatctaaaggaccagggtgtgttttgagaagggagcctccatgccactggaaacatatccctgtaagctccttccacgctttcctttccaagtaaagtttactcagtccctctgctgaagaaaacataggttctaaattagtgtaattgaactgacggacttttaaggcacaaatatgttttctcctttgcacttgaatgagttcacactcccttaagcaccccctcacacacacatgcctgagtgcacatatgtgcgcatacacatacacacacagacacacacaagcttcagaaaccctgggaaccaggtgagtaatagtaacaaggtcaaagtgaccaggcctgcaacaaatatggcaggactgtctactccaggccagccgcgggcatggggcagccccgggctagcttggagcctgttcccttagactcctggctttttagcagaagagccaggcctgagtctgcctcttactagtcatgtgacccttggccagtctctgaccctctctcctcacctgcaaaatgggacatagcaatgaaacccccctgccctgctgctgggagagcgggagggatcacggaggaacgggtggcaatggaggtgctgagcactgcctgtgtccgggctggtgacaggcaaacaggtttcttatagcacaacaacgcaaagagtcaggaatcgggttggaaattgtgagaagaggagcagtgcctggatggggagtgaagggatgctgacccagtgggcaccaccaggtcctccttgtctgtctccattcaggaaagaggttggcagggctggtccacaaactgtggctgggctctaagaaagggcttccagagaacaagatcggaagacacatgagggccatcagtcgctgggaaaggaatgctggccccaaatcaggagagctaaggcccattaagtcccatcttgactgttcggctcactggctgagtgacactgggcatgtcactagcccctgtgggtcagtaacacgaatgggttcagcaggttaaatctggctcccctccaactctgacatcctgagggacccagggatgccccagacctgtgggtcacatccatgggaaacaatgggagcccttagcagccacgagggcaacctccctggggtgacatagcaacacagtgccagtttgtcgctcggtcccacaagggtgggccagggtgctgatgggggctttggagagcttagacgcccagagagccctgggcgccaggaatctggagataagagggctcccccgacccttcctcacaggtagcttccccacctctccccatcttcgtgtggcccctcccagggtagcggcaagaagcaggagcaaaaggaagggcttcacccccaggactgggaattgggagagggtgacagccgaagccaggcacccccaccctgcattgcaggggccgtgtgcaagtgcacagtttccctgctgccactggagctgccagcccaggtctgagagcaccttggggacagacattactgctacagtgtacttctcctgccaggcctagccatgcagccagcgggcctggttgtggaaaagaggggttgagaaaaattctagagataggccatttgctcgtgaggagaaggtggagcaggttcaatgccttggggttttcctgtagcttaatcctggctacccatatggggccagtgagttctgggtcaaggagtgctgaggtgaggagggggacctggaagctggccccacagccctagatgttgcatctcatccttgtcacatagtgtgggttctgggaggaagccagagagctctccagaagggacttggccaaccttttatcaggaaaacaactactccctaaagaagacagcacaagggaagaggtgtctgtgcctcacctcagacctcaccaggagcccaggcaggcttccccagcatctgctccctgccctccgtcctcttctggaaaggccaatcctcttatagatcagagtattcaatattcacagtaccctcttgttcctgcttcagtcacaatgagcaagaggaaaatcccgttgctggcaagcagcagtgtctcaccggccatcttgacccccagggtctggcgtggggatcggctgctccctggctgatggggtgaaatgaagtcttgctgggggctgcggggaggtagagtgagtgggcaggaaacagcctcagcccaggcaggtcccgggcagcccgggctggaacttccatggatggaggggaggccgatgccgggagatcctctgggcaccccatacctctcctttcagggcctgggcccacccccgaggcctgccctgcctggcctgcttctctgggacttcaaccacgttcatcctgtcttcattctgggggtcagatggttctaagcaggggtactgcggacctcaggcctcagctgctgtgacactcactcctaagaccctaagaacctgccatgaagttaccccattcgtcctcagggaatcagtatgggagctttgcgtgagtgaccaccaaccccaccacccactgaccctctgccccaacagttccacctcccctaggccctggtcagccacatgccctctgagccactctgcccacttctctagttcctgccaccaagccaggggcccctgatttctgccagctgtttgcacaatgcccccaggaatgtgccaggaagctgtgctgtgtgacagagcacaggctccactcacagctctgctattgggaatccccctccccatttgtaagacggggcttacggttgcctcacaagagtgtcaggattgagtgacgtgcacctgcgagccacccacccctgtgcctggcaggcggcaggtgctaagccagtgttcacttccttcttcttcactgactccgtgttaccctgatgtcaacttctaccctgagcagcacctgaccctctggcttaggcactgtccaagcacgttctcagctctagctccccaacctataccaagggctctgcagaagctacccacacaggagccctactggcccaggggcaggcgtagggagctcactcactcagtattcccctcacctccccaggctccctgagttgcagagatggaatgaatctctaacctcaggggcactccactctcagcagcacaaaatcagtgttccagacctttgcatggcagcatatgcctgccctcgtctctggagagaaagtgacttcggccctgaccacactcacatgcacacacgtgtgtacaaaagtgcccatatgtttgcacacactcacatgcactgcatgacaccagagaggactccggatgctgggctctgctgctgctgctgtctttaggagtcacatcttagagaggacaaagaaagaaatcccagctttagtcttgcagctaaacggttgagacctgagcctttcctcctgagtccctgtattctgtgactctctcctcttctcattttctccacctggcctggctctcctgccctccatgacccccacctccttctgctacccagaccctcttccgctggtctcctctctgctggctctcatctgggaggagtttggggcagcagacactttctcattctcgttattgatcattcttccactccagtggagacctgcagaagtcagataccttcctcctatgctggggccagagggcagtggggcacgtgtgcatggtggggctctgagacagaggggcacggggtaggcatgcagaagcgtgttcatgtggggtcagtacacgcagcctcacccaaagagtgttttttaatcagttcccacgacctctagagagctagaaaatcctctgctgcctcccttctccaggctgagcaccagagttgcagaagctcccaaagccactcaaaggagccggggcagccgggcagccgggcagctgggatgctcttgcttgagacacagtcctcctcctctgctgtgagctcttctccgcttagtaatctcagctgatctgggcagccagaggcctggctgatgttaacgcctttgaattatagactgacttgcttgcctaacataaaggttagctggccagtaccagactgcagctgtgctgtgtctaggccttcaggtcttgagccatcggggtatggagtcaagtctacctgggtaaggcctgtgccagaacagggtgtgaggagaagaataatttgctaattgttattcattttcttgtcttcatcctcattgccacagcactgggaaagcattgagagaacattccagaaaagttttctggaagcctccctaaagtgagataggagcaccgttttcccctgctctgaaccctggagtggtagctctcttactgccccacctacacccctagaaggccccccatccaccagggtgcactccgtagcaggacccccagccctgcctcaccctcacagagcaggcttagcccactgttcccctagaggcccccagagcctgggaggtcccaccccattagaggggagcaggggagccagtgggcagaggagcagggtggcccaggcccagagggtagccaggctcatctaacgctgcgttccctgaggaacctgtgacccacattgtgaaatcatcagagcctggtgggggagatgagctgaggccctgaggtatcagagcttggggttggaatagtggccacccaggtccagcattgtgggcccctcccctctccccgcaggacagaacccagggccatgggacccctaccctgcagacctaggcttgctaccatgagaagctgtggggtgagaggtctgtgggacaaggaggcccctggggagcatgcaggtccatggggccggggctgaggccagtgtctctggtccacagcccctcacacacatccccttgtctcctcatttctttcccctactcagcaaaggcagagagaagaccaagggaggcagagatggcgagcacaagtaggtgtcccaggccagggcagatggggcagtgtctctgcgggagcagagacctcctccccacaggctgcagagggcgggacgggcttggctgagagggctcaggagtgggctgtcatggtggagctggaacggggtatgcaggcccagggaggccttttcacctggccatgggggtgagggatgaggaggggttagggtgggggcgggaggtgtccaggccttctggtctccactctgggctctcaggggtgaccgtcctcctgtccgagtcttgttcctcctccactgttcagcccccatcctatggcctttgggcttccctgggagggaggggacagttacaggcaaaggcgagaggggtacaaggacctcagggacctctctgccaacaggggcgaggcagagccaggcagctggaggcataaggaggaggagctctgggtatgctttgcagcagcaggtcttgggtagagctggagacctccagaaagctaaggagaggccaccatttgggtggccctctctatcttcatctccccaaaaggcttcctggaaaaatgaggtcagggtactgtctggagaggataggcgaagggtcctgcaggtgggaagggccagtcacaagggtctggaaagattcaaaggctagggcttgtgagtgggtctcgtaggcacccctagaagcacactgacatctggatgactctagcaacacgggatctcacaagggcagggggagccaaggcagaccacactggaggaggcctctggtcaacacctgctcttacagataacaaatctgagtctcagaacaggggcagagctggaaccagaacacagagaaactgacttctgacctggagctcaccatagacctaggaagtttagagcacttgactgtactctaaatttaatctaattctccaaacacaccaatgagagctgaaaagccaggagtgtggtcgtttttatcttccagatgaagaacctgagccccagagatcttaagatatttgctcaaaactgtggcctcagtacattaagaattagttcatctgaagatatcatggaaatatcaggattgtgtgttgaggggtctgaactgatcaatactggtgtggacttggagtatctgttggcattaagatcctggggaactcacagcctcattcattgcttccaaaaaagtatgagttctaactcacatttgttatgcacaagcaaaagcaatgatgatgcagtgttaactctgcagtgatggaggaaatggcaccgtgtaggaagagctccggcccagagacctgaaggatcgaggagtctgccaggttcccagtaagggaagaagcctgggcagagcatgtgttaaggctcagagccagggaactgaatccagggcaggtggagatgatggggaatgctgaactggggagtcctcttagggagtcctcaaggctttgggtttctccatagatgcttagatgtaaagggcatatgaatgagatacgagcagcctgtccatccccaggttccctgcctgagaacagagatgctgtaaggcccttcttgatgcccagctccccagtctgtcccaggccagaccctagggacacagactgacctgatccctttgactggctacagttggagtaagaggtgcctcacagtgccagcacatagtagttccacaaaaatgctggttccctagcccttctccatcctaatttcttaccatctctaattaacacatgagataaagtaaactggcatatagtattattattattattatgtgtagagcaataggactattgaaataataggaaaatgagatttctaagaagagattgaacgaatttaaactctttagcctggaggagagaaaactgtgggaacagatttcaatctctgaaatgttaatgtgtggcaaagctggttggtatctatctccactgagaagagataaatggaaatagatttaagttgaagtagagaaacaagattcaacccacaaagtaactcatattgtgtgacattctgggatagactggtttggggagatgggaaatcacccatcatcttctatgatgctgcttgcctgagccttgcaaagggctgggccaccagtaagaaatgaagagacagcttccctgacaatcccggggtcaggacaagagtgtgtgggcaccccaagccttctggtacttcattctgaccacggtgaatgcagccataggaaactcaaacgaattctaaatcctcagagggtcctgggatactggcctccccttggctctcgcttctcaagctttaatgcgcccaagaataaggagccatttggttgtaaagtgagtcatgtgtgcaaaggggccagtttggagacagggtggttcttgtgtaaaggatcagcctatcctgcccacctatgggaagttcttcaaaaacgaactgaaattcaacccactttcaaagacacctgtgaagactgaaattatgaaattccctgtgtcttggggtatggaaaattttttaaaataaacccatttaggagtgcttggatgacatgctctcaggttttgaaaactgggctatttgagcaatgcaaagacggaccacagaccctatttctcatagataggagtctttatcctgattgattacctgaggcctgagctaatgagcctagaagttccagttgaagccagtcatggggcagaagccctgggcagtgaatggactcaacctgcagcttatttagggtcaggtctctattaactttcagaataacccagagacttgaattaatgaaacactcgggtcactaaatttagtttggtgaatgttcccaagtcattataaatactaagctcttcctagaaccctgtgtgcaccacatagccaagcaatatacttctaaatctgggccataaaatgagtggagaaataatcagatttacagtttacaataagtgaactaattttagcatttttcctctagagagagataccagtctagattgtaggtgcacttcattctgaccacggtgaatgcagccacaggaaactcaaatgaattctaaatcctcagagggtcctgggatactggcctccccttggctctcgcttcttaagctttaatgtgcccaagaataaggagccatttggttgtaaagtgagttttcgctgagttgattattggctcgttttctttgtctgtttctcaccatatcctatttttggtaattgtagaactcaactagaccaaatgcagaattttattttgaaagccataaaaggccaggacaacagacacctcatcagcaaattagattttttgaaatctaagtctctcagacaaatagataatcttcaaaattccctgattaagttggcatttatttcaaaactctcctttacagtttgccaagagaagcaggcatactgctttccaagaactggtgctacaatcaggcagaaaagaccttttccatagtgaacttctgatgtgttactgatcagaaaattacaaagggtggtggcagggatgacatcatgctgtactgatcacaattcagattcactgaagagcgagtctaggacaatcagaggtacagagcctgtagtaagaattctggaaattacatccttcactacacatttctgcatttttaacaaagggacaaagacaatatccttttgagatattcccaggcacacaggagtgctaccagtactaccacttcagagggctaaaattttgcagggttggaagggagagatttctcctttgaattgcttcaaggtgtagtagaaatagttggacaagtatagttttggtttgtgtgtttgtttgagacagagtctcattttgttgcccaggctggagtgcagtggtgtgatctcggctcactgcaacctccgcctcctgggttcaagcgattcttctgcctcagcctcccaagtaactgggattacaggcatgcaccaccacgttcagctaattttagtagagacggggtttcaccaagttgaccaggctagtctcaaactcctgacctcaagtgatccacctgcctcggcctcccaaagtgcagggattataggcatgagccaccgcaccgcaccggctttaaaatgatttaaagcctcgatcatttctttcaaatctgtttgtgttaaggaataaagtgaccttcaaattcaagggccataagtgccccagggatgcctcaggtccttttccacctgggtgagtccatgggaccagcctctgaaagccatttcctgctaccttgcactcccccttggcctcaggcagcagggccagatcccatcccagcaggctgggcagctggcttctccaggcagggcctgcttctgacctgccatcccaaagcacttcccctctggggaagcggggaaggggaaggggagagggaagtctgtggctggagcaggctaaaatggcaaagggtaactatgtaggtcacacatggggaagggccggggactccaagaataatacagcccaggaatggccaagaagtaatggtacaaagtcaaaggctgagccctgcaggagactcctgggtaattcaggagagacacagttgagcagcaagcctgggcagaaagccctgagacaggaagtgacccacgaggaggcccacagaaaccacacttctgaggctggggctatggcaggggtcaggacagccagcactcctgcccttggggccaccaggtggggagaaatcccacaggatgcttcagggcaagccagccagggtggtcctttccccaccatcacacgattatttctggtgggttcattgttctgttcaatgttatgtcaccagcaatttaacatgcacagccgccccttcccaaatgtgtgggtgttcaggttctttttgaatgagccccttctttgtaaacatgggtatgatccatgagatgccacagatgacagcatcctgatctgtaaactatgctggcacacagaccatacctgtatctacgggtgccagccctggggccttttaactaaaatcccaaatggtcaggatgggatgggattcatgcccatggaaaagtgcagtcctacggcatcgaggcaaaggacccaagatgcagtgaaaatatttctggcctagaacacaggagctttctgtttcaatcccagttctgccactcaccatgtgaccttgtgattattttcacctctctgagcctcagtctttttattggttgaatgaggagaagcatgtggccctcagaggattgcaggaagatgagatgagcagacatctgcagacattgcagacatctggaaaggcctttggccctctgtagtctgtttttggccattgtgtgtgtgtgtgtgtgtgtgtgtgtgtgtgtgtgtgtgtgtgtgtgtgtataactcacctccccccatcagaagggaggaagcttttaaaaataattccaaaggcatcagctttgattttagagcctctttctttccctttcttcccattgtcgtattgcagacggtatgctactgaagagtgcagacacatcagccttcttccattcctttttaggaattcaagaacatgctaatgttctctagattgtgagctgctgccacgtgaaaagggtgattctcaattgctccctcactgggatatgaacgtgctttgtcttgaatatgaacagtaaagaaagggcctggggttgggatagggccaggtttggggaataagattggctccaccatcctgaggagaggggcttgaggtttctaggtcatctgcctgaggacagaaaggttttccccaatctcccattgcccagcataaagaacaaggatctggggtcttagaaaccatagtcaagcctccacggggagatgtgtgacccaaaaagggtggactctgccgtaagtgagctccaggttggagcctgcacctggccccacctggcctacaggatgatggggccacacccaggaggagggagaatgggaagtggagggagtcaggtatccactcatgcaatatggatggggtaatggaacactgcactttaccccctgctgatcctgctcctggtgcttcctggcaccaggaaccacaggctctgctgcagggacatcactgaagggcagtgaggacccctgccccttttcctcagcccccccgactgcaaggcccttcgcctgggggcacaaagccacagcaagccagaggaagaggtaggaactatggagcctgccataagttcctggggttgggggaaaggggaattcggcagtgagaggggacaggtagaaggggcaaaagccaagactgaagatagatgggaaagggcctatctccccctttttcatggggaccaaggaacatcccagaacacggagaggttggagaaaggcaagtcaggctttgagcaccgaggccatctgagaactgaacagctcgtttcaaccacatctcccatctcctcatcggcctctgtccctgagtcctctctggtccctgtcccactgttcagatgctctgtctccggtcctcgggctttctctccaaccagctgagccagggaagatgagcgtggggacattggcagggctcggagctctgagactatactgaggggctggaatcagactgaaaagaccaagacccagaggagctccagttaaaacggctcttcctggctcaaggccacgttccctgcttgctggggaccccatccctctcctctgtgtgtgaaaggatggcaaagggggaagtggaggggtctctctctgccctcattccccctcatggctcccaatttgggaagacagatcccgacctatttcgggaccagcaggtgaggggccgggtccatctcctttctctgatatgttctctcatgtttggctcttctgtgtttgtgtgttttcctccacgcgtccctctccctgcacctcattctggcggccccctcacagagctgggaggagcgtgttctccgccatgaagctcggcaaaaaccggtcccacaaggaggagacccaaagaccaggtaggacaggcgccgcgtccccgcgtcagccccgcgcctcgcggcgccctcccgccgcttgccagcccctgcccagctgccaaaaggtccgcctgggattggtcatccagagccatctgggaggggcctggactctcattggctggcccagggccaggccccgcccagtgaggcgaggccctctaggaaggggacgccctggggccgagggagggaaacgggccgcgccctctgtcggctgggcctggttacaaagctcctcacgccctcgttgctcccggttctttcttcttcacacagaagcccggagttttaattagagcagagaatatccatcaagaaacgctgtttggccaactccctatttctggggggaaactggcgtcccactagtgcagggttggcggcaggcctcgccagcgccctctaatcaggctgcagcctggccttaggggaggtcctgggggcgctggagggcgcggcagggccgagcttgggaggctggagcagcaggtggcactgggccctctcagagcagcggctggagaggggaagacaggcagggaggcctggaggaagacaaggggagaaatggagaggacacgggagctgggagggggccatcttctccatcacgggcccaccatcggggctcccggctgccctcccccagcatcccctctgtggcccaatggccctcagtctctctccgccaccctcttgtccccatgccaataccagccgtgcccttcaccttcttaaatggagagagtacagctgctggctgaggaccaaacccagtatcctctggtggcttttcggaatctacatgtctgcatctcattagatgaataccagtgcattcggttctgaatgccatcagctatttgatatggataagttacttcctaagccttggtttccgtacctgtgacatgagaataatgcccatcttggcagggcacagctctaaggactagagatactcatgtaaagtcatggtgttgtgcctggaacagagtatccacccaataaatggtagctatttattgagaggtgcaaaagtatggattctttattccgtaccttcatccacaagggatattcagtgcctaagtaagtacaatgcaataaaagagcattcaattaaaataaaaaggcaagaccagacataatatccgttcaaatgcaagatcgggattaggtagaaaaacattgcagttattcaggccataacattctaagcagtagcaactaagtaaacctcgaatttaactctcagctttctggatgccagagtaaaaggagaaagagtcactatctcaccatcagtcagcccacctaaccagtctttcatcttccccagatgaaccagcagtgctggagatggaagaccttgaccatctggccattcggctaggggatggactggatcccgactcggtgtctctagcctcagtcacagctctcaccactaatgtctccaacaagcggtgagtggatgggagccccacaaccccaactgcccccaccctgtcaggcaggaccttgctatgattgaaatttgggtagggaagaatcagggcccatggacagcttcttcctaacctaatcttacccttttctgctttttcttgggtgtttctctcacctctgtccctgcaaaagcagagcacaacaggccttttctcaggtctttgaatacctcccagcccaaggaagccacagacctgcccaccccatatttgaagctattgaccccatgtctgtctccctgttacttctgcctttgattagttctctgtgtcaaggcctctgaaggcgactaatccccactattcttggcagtgcttgagtgtttaaagaccacgactctgtccctctgcccactcccaggtctaaccactgcccatgccctcctcccccacaagcagtccccatacaccaggcctgatgatacattctgttcctcagatctaagccagacattaagatggagccaagtgctgggcggcccatggattaccaggtaggtgggcacctggaggcctcatgtctttcagactctgctttagtgggggattctagctggatgtgcattatccaatatattgaggcatggatccaggggtcatagagaaccacaagctgaatatgtttccaaagtaagcttgttcctgggaggcattcctagaaataccatcagtagagagatacaaacccaaagaaaagcttgagaactctgcctatgctaatcaaagcccttccagtatttcatgttcagcattagacttcataaagtgagaagcacctagaaaaaccataaagagaccaaggagaattacaaagaaaaagtattcaaagtgttaaaataagggccttggaagaaagttttcctggaatgatttttaaattgttgttttgtattatttgattgctagaagtaatgtcgattctggttatctctggatggtgagaatgtgagtgattttttgttcttctttttgcttctctgtattttatgagattaacacaacttttttatttgtgtgcttctaagactggagacaaaagactgagacaaagagacaaagagaggttgacagctagctgtgagaatgtgaatgtggccaacagtgcaggcaggacaggtgatgagcatgtctggtggctgctgggacaccatctctcaggaaaggcccagggaccctccattgctccagacactcccttggaggctaacaagactcagctataaatcagaagactgctgggcattgctagcactgagtgagaatgctggctgctcagaggggacagggcttgcaagagatctcagctggctgccactgcacttctgtcctagatatgttctgtctgggtatcagcaccaggccccagaatctgagtgagccccatctaccggggtagagctttatctttgatacctagttcccagaccccatgcacaccaacccttctttacagagaaccccacctcccctcactcaggtgatgaaggaaaggataagacggcacttttctatgcaaaagatacatctggccgttttctccagaatatacctcatctcccttcatctttgttttagttagtttccacctactcagcacctgtcttcccaggtgcctgaaaaacagccacaggcaatgtcaagtgaacctgcccctatggttttaaacaactttaagccattgggttccttagaggtttgagaattctggccccctcacctctgccaaaacccaaaacacaaagtgtcctgagacttccaaaggcttttccaagggattacgttcagggttttgtttctctgtgtgccaagaacagaaaatttccaaagaacaaagaccccaactcagagatgatgccactggcctgagaggtaagggcacatcaaaaatacagtcattattgttcatgaaacttattttcgaaggtttatgctatgccaggcactgtgctaggagccataaatgtgtttccattgaagttaatgtaattcttcaaccacccaaatatacgtgttactgcattttataggtaagaaagtgaggccccaggaaggtcaggagcttgtcccaggtccttgccacatttagccaaggctagagccagggttcaaggccaggggtatctggccacagccatcagaacaattgacttctctatatcaagccttctagacagctgctcccttcgggtacctggttcatcttcatcttgctacttagtgcttgttttccaaatcttttcaaactgcttcccaccagagatttttattaactgaaccaaacattgtcccctccaaagactttttaaactgaactgaacaaaacagttgtatttaacctggtagcacagtgtttcctgacaagttcattcacagctcaccttgcaaacatttgagagagagctatgaggatgcaaatgtgaaattattttcacttccaatacatacaatgtataatgcagtaaaaccaggccgggcgcggtggttcatgcctgtaatcccagcacttttagaggccgagacgggtggattgcatgaggccaggagttcaagaccagcctggccaacatggtgaaaccccgtctctactaaaaatacaaaaattagccagtcatgatggcgcatacctgtaatctcagctacttgggaggctgaggcaggagaatcgcttgaacccgggaggtggaggttgcagtgagtccagcctaggtgacagagggagaccctgcctgtctcaaaagaaaattataaataaataataaaaagcaataaaaccagatgcaacttcagtctcttggagactttgggtttgatgagttataaagacctcaggaaggacatctcattggtgagaggaggggagacttagctgaactcagctccaggaagggttgtgagggttcaggaccattctaaaggttatggcactgaaagaagcctggagataaaaggaccatggcattcccatgctccctgtttcttccatttagaatgcatgtcacatgtaaactctttcctgattattgtcatctccaaggcaagaaaccacagtcatcccctgtgaatgtgcagtttccccaccagagtgagcaatgcttggcacttggcagacatgttcttggtgggtcaaggggtcttgagtctcttcattaccctctcttcctggcatcaagacttaagacattgtcacccaacatctctccagttttcacctccatttcatgcccctgctgctgacctgaggtccccagcctcaattgcgtgcttatacccactttctacctggtctctctgcccccatattgcctcctcccctccaacctctatgccagcactgaagcaatcttctgaaaatgcaaatctgatcatgtcacatctctgccacctggaaaagtggggagtgggtaacggatgttgcagaagggcagtactaaagggcacaccaactctcatctctagctcccggcggatgttcttgaagctggatcaggtccgtaggaagcaggccacaaagcatcgttactcttgggtttccccaggacaggggtatagatttaccactcagcattattccttgtgatcactttcatcaagccactggggagtatgtcccttatcttgaaaggagatggtggaatagtcagctggtcagttggtcccagctgtggcaccatttgcctcttcatcttccaccctgggaaaatagagtcctctgctgataactggagagaaggatggccaagcccctcccccagaaccctggagaatgaccagctgttttttattttttatttcaaaagcatcatttccccttcctagggccccaggcggggtgggaggcaataggaatggcattccccttcccccaacaccatgcacgtggtggtctttcttagcgccctcagcttcctctcggggctgcccctcaaccagcaatgagcaccctctggagcttctcttccttccattgctccttcaagtttctgcccacctccccctccaccctccgcctctactgccggagcttctgtccaggttgtcaccttcactgattctgctccatggaggaagggagatatgtgtgagtcctgaaatgggggacagggacaagtagcctgtcctatggccatgcctcgagatggaaaacataaaacttaaccattctcttggcagtgggaaggagacttgccactggcttatctttggcagatgccaaaactacgtctgtccgcttcccagtcttgagttatagaaagccttttttattgttggtgggggtatgagttgcggaaaaattcatggggttttttaaaatctttggcaaaaaagtgatcgtggaagttaaaactctataaactagtgtgcaaaggaggacttctagtgtctgtctgctctcttcacagtaaacttctcagagctaagttaactagtcctatttcctttttatctccctgaaggagtggtgaatattgaacttctgtgaagctccagattctaagcttttacttctgtccctttggcacttcacgttcgaaacagaaatgtttgcttcctagttcaagtgtcacttcatttgtaaatatcccatttcctggcaatgttctcattaatatcggaatttctatttccttaacctgattacttccgatgtgtagatttttcgttgccctcaggatatgtttcagactttgatggatactggatgatcattttagtggttattctttttcatgaaaggggaagataattctctcaagtaaagttgtgtttagaagttgcatcaaagcacaactaaaacatgaaatctccaagatgacaggcatgaagagcagccttcagagtctcattagaaaaatgtgctgggcgcggtggctcacgcctgtaatcccagcactttgggaggccgaggcaggtggatcacgaggatagattgagaccatcctggccaacacggtgaaaccccatctctactaaaactacaaaaatacaacgtgcggtggcaggcacctataatcccagttacgcgggaggctgagcctggagaatagcttgaacccgggaggtggaggttcagtgagcctagatcgtgccactgcactccagcctgggcaatggagtgagactgtctccaaaaaaataaaaagaagaagaatgtactgaggtccacacttattctagctggggaaagacttttctgttaaaacacacgtttgagagaggcaagtgaatcaaccattctaagtatcatgcacagcctcacctacttgagagatcacccgcttagctgaagggagattctactggagtcactcacattttatagagctttctgccgttgaggatgcattttgacacacatgatctcatttaacctgcacacaaccttacgggtagttggtatctctgctagtagctgaataacacaaggctatgtggtcatttgctctcacacctggcaacatctcaggtctggggttcaatgccaagttcagcaacccccagtacatgcctctatctatcctaccacggccaccctgacaggaactgacacctccaaatccaaatgagacctggtggcttaaaatgagcgttcgggaaaagcagtagtgaagtcaaaaattaccggtactctggctctctctctgtctctctctctcctcatatctttttatcttaaaaagccaataatcgactgggtgcagtggctcgtgcctgtaatcccagcattttgtgaggccaaggcaggcagatcacctgaggtcaggagttcaagaccagcctggccaacatggtaaaaccccatctctactaaaaaaaatacaaaaattagccaggcagggtggcacgtgcttgtaatcccagctgctcgggaggctgggccaaaagaatcgcttgaaccagggaggtggaagctgcagtgagccaagatcacgccactgcactccagcctgagtgacagagagagactcactgtgaaaaaaaaaaaaaaaaaaaaaagccattaatcattgtggtaagctccacaaggaagaatttgttgcaatcccacctgtgcctggctccagcaggtttccaggaaacatttgttgcatgaatgaacaactgaaaaagggcttcccaggatataagtaagattgcagagagctggatgccatgtaaaggacacagcagagtgcatatacaacatataatcagtaggctgaaaaaggcggctcaggcaggcaccaaagccacactggccattcaaacaaagaaattcagcaaaaggagaaggggcaggaatgtggaaagggcgggccaaattccagaaacgcaaagacatatcagaggcttgcaggcttacatgagaattcctggagcaggaaattaaatgcaagttaatgaagactttaaaagctttattcctgagtgcatgaaacctatgacacgggtttggcagctctttctgaagcagagacatcaacgctagggaagaatgcagggcacttggtatcacctaggagctttaaaaatacagatgccaggccgggcacgatggctcatgcctataatccagcactttgggaggccaaggcagacagatcacttgaggccaggagtttgagaacagcctggccaacatggcacaaccccatctgtataaaaaatacaaaaattagcccagtgtggtggtgcacgcctgtaatcccagctactcaggaggctgaggcagaagaatcacttgaacccaggaggcagaggttgtggtgagccaagatcatgccactccactccagcctgggcaacggagtgagactctgtcaaaaaagtaaaactaaaaataaataaaaatacagatgcctgagctgcatgccccaggattggattggattggtctggaggtggcctgagcatcagggtttttaatgcctctccctccctccggcccagcaagttaagtctagtgaacactgacttagaggttagccaactcatactcctctacaaatgaagacactgaggcttggaaggagaaggagcccaggatcacccagcagatgagaggcagtggtcagagtggagtctggaggccagcgctggctcccgggccctcactctgactctgctgccccagcccctggacctttgcggaactgggctcctaggctcaggcagctttccttctggcttccccttctcctgcctataggtcagcatcacggtgatcgaggcccggcagctggtgggcttgaacatggaccccgtggtgtgcgtggaggtgggcgacgacaagaagtacacgtccatgaaggagtccactaactgcccctattacaacgaggtcagtggccctgtggggaaaggagcctctgtaaatgtggcaggagggtgggtcccagtcctccccaggagaaacaggagtggctgggagtcaaggagcacacacggctaccagcaggggtgacccaccctgttacaacccccaggacactgacaaacagagccacatcctctgaatcctctgaaccccccagtctagagcgcagactgacactggtctttgaagtgtgcaccacctgggtgcccctgtgcagaccccagcagtgcctgtgaaagaactgcccccaccccactccccaggaggcctggtccccactgttttccaggccagagcccaaggacagggctgcctcatttcaacccatggcgacattggcaccattagtaagcactttctaccagccaggcatgctcctaattgcttctgaactggaccatccgaagttgtcactatcaatttccttttacacaaggggacagtgagacttctgaaggcagaccttgtccaacctcacagtgccagcattgccgttggcatgctggtggggttctgccctcttggctcggctccttcatggttgcctgaacttctgtgggtttccctccagagcactggccttgactttggggtgtcagagagaaaacatttggtacccactcctattctttccagccatttgaggccacatcaagggtgagggagctcagagaccctctactccaatctccccatcttacagaggaggatactgaggatccatatggaagggccttgcccacaatctcagagagtgttgctgatggagcaggggccaggctgcccacccagcttccagcccagggctttggccaccatcacaaatgtggcaccttggttcccaggctccaaacaggaccccatcataatcagctctggggagggatatgagaaatacactcactcatccagacccaaataatggacttagaggcatgaagaacagcggaagtgagacttctaataacggtcttgaaagacggagtgtctggtaggcaggcacacccggggcagtcacaacatgtaatttatctcctagcatgcatgtccctcccccagttccccattggtcaagtactacggggttacaatcttccctgacatcgcctaagcttcattttcccccttataaggttatacccgactccccttccccatttaagtttcaatttcccaataacaaaacctttttcccttttatgggctgacctctcctctacattctgttcacttattgtggcctaggtgcataagccatgtggtttgttacattcgcaggttggatgccagtacttagacttatcatgtcttgaaaatgggccatttaaaatgttttctcaccaggatgcccaggcctttcccagatgcctgagcacacatcagactaacccagaagccactagcctgggctctgccatccctttcctggagggttccccagtctgtttctcctggtggctctaggcagtgaggggtgccaggctggcccaagtaaggcagctgagttccataccctgaggtgggtgaggactgaggtgtcccctgtagcttgggggagggcatttctcaggccgctctgagagtccttggactgtgcacctgcaggaagaaaacccaggcccacctctgcccttcagcccaggcctggccgaaccctcctttgtgaccacaaatcaactctgctctcccagctgctttcccacaggcccccagagctggacaacctgctcaggacccctccagccccaaggacattcaggattgacatctctggccttacgttaggacacatcctgactggacaagcctctgcctagaaaagcatctgtgtccccatgacaggcatggagacaggtccccgtggcccctgtggttattcgatagcagtgaagccacttttgttgacttaagggatctccctccaccaggcccacgcaccttgggttccattcaaattacttcctctttcccaagggcacagagctgctctccccactctgtggctcctccagaaaactcccactcacctggcagggcccagctccagtgttcttactactgagcagccttgcctcctgtgtctgggtcagaggtcagcactcccctttctctgcagtgttaatgtcccagaattgaggttggtcctctgtgtctctgtcctcctggtggactggaggctccccatctcctgcctcgctgtatttgttcagagccaggcatgtactcggaggggttcagtaacactcacccaaaggaagacacaaacatccacggagcatctgccgcacgccagacggtggcacgtggggcaagatggaggctgctgagatgaaggaggcacagtttccaccctgcacaggtcccttcctcgtttcagcctagaatctttctaaattccctatttatatcctctaagactattcattctgctcatcttcagatgattttaaatgtgtctctgatcacatttttgttctttttcacaaacctaaatagctctgattttgtttctgtttcctctaaaccagggtttctcaaactcagcactgtggatatcttggactggataattgtggtgggattgtcctgtgctgtgtaggatgcgagcagcatccctggcctctacccagtagatgccaataacaactccccttagttacagcaaccaagactgtttccagacatgccaaatgtcccccgaaatcgcccccagttgagaccaccattctaaactatcttgctatgattccttccagccccaaatcagcctttccagccccaaagctttctttcccttttcttatctttctatgccacattccttttcaatgaagggcatcctcctcgtcgtgggaatgtattatttctgactaattatctgagctggcaggaaccttcctttggctccattaaaacaacagagggaggtgggagcaatcaacatgacttagcaggtatctaagctattaccaaaggaaaatatgctcaggaaataccaggaatttgattgcagacagctcagagagttcgggattctggccctagctcagctagctcactcccctggggctggcacagctgtgggcacctggcctgatcgccctgcctggccctgagcctacctgtgtgcagggaagctcacaacctttgcccttccagaacaagctggccattcacaaaccagactaaggctccttttctgtgtgtcctgtgtgtgcatcaggccccgccctgggcatctcgggagtgccgccatcttccctcctgccaaaaatccacctctcccctttgccttggatccttctctttctacagctcaaagaacctgacattgcacagcccaactctgtctttgtttttattccagccccttctcctttgcctgtaaggtgttctactccagcatatgctaagtacaaccatgaagacccatgtgtgctcaaggacaagaactaggagtctgtcacctctctctgggcctttcctcattcccacacacctctccagtgacctcatttttccctcctcccctccacagtcagaccacttggcttgttctcacttcctccccgcagtcactcagtctctgcagggtttccgcctctagatgtcattgacactgctctcctcaaggtcaccaaggaccttgctgtttctgagtataatgtccatgtcttcctcctctcccttgatcacccagtttctttcatcccactgcctgctgctcctcttgggggcccctcaccccactctcctgcttcccctgtctctccagttccatctccctggcctgacttcttggctgaaaggccatagcctcttggagccctgacctgggcctacttcccctcccatgctctccccaggtacctcctccatccccaaggtgtcagttaccatcttgtgctgatgatttccaaatccatatccccacccgcctccccagagcttcagaaccccggccagcacaccctgggcctgttagtgtcgcgcacagcctgtttaccgtgtgcttaccgtgggtgcacacctgggttaaagatttcaccaggttgtctcattgcaacttcacaaccacaccttgaagaccgcgtgtgaatggcacccctggagcagttcagcacgacagccctggatcatatctccacattcatagtataataggtaaactgaggctcaggcaagaaagtgattggcccagcagtaacagccaggtggggctggctctgaagctttaccctcagcgctcaagggccagccccccgcagccaggagcacgttctcttcgaacatttaccctaagcacgttggaaacatttctcctttcttctcctttctcccccaccacagttcaccaaagcagcagcccctctacttactgccccacaccctcatcctcagcgcctgcacacccaggccaggggaagagatggggactgcaaatgcgcatggcagcccacaacaccaaaggacagtgcacgcccatggcatttcacagggactgccaactaagtgctttggcacaccatggttcatctgctctgaggcttgcgttattttacagcttcacctctctgaatttgggatgtgtctcctaggcagccttgtggcttcatggcaatgtccatgtggcctgttaaaccgtagtatatcttacagccagtagccactttagatttggtaaattatgttacattgtctcatcagagcctcataacaagactctgaggtgggtgtcattattcccatttcacagctcaagaaactgaggttcagagaatgtgttgctcaaggccacacagctaggaaggtgcagagcggggactagaacccaggtctcctcgctccctggccctgtgcctcttctgagcacagtacaagggcataggctcttccacctactgttcccagttccttccccaccccacactagccagcaccagctccacctaggggatggggctctgcttcctaccacccaccaccagggtcaatcaggatcagacgagttgcctctgctgctcctctgaactttggggctcagggcaaatggctggggtgcagacaggcactgcgaggagggaggggcccagcactgcctaggctgttgctgctgcccacagtgacagcaggcccggatccttcccctctccagtacttcgtcttcgacttccatgtctctcctgatgtcatgttcgacaagatcatcaagatttcggtgagtggggagcagcccctggcaggcaggaccactccctcaaactgcacctttgtgcacacttgagaggagctccctctgtctagacctgtcataaagaggcagtgccgtgcctagacacatggctgagcaagtggggcacaggctggattctggcccccacccaccccctttcatccagtgcctctgaatagtgtattcgcccgtacacggtggccagcgagaaactggcgtgggcaggaggagctgatgctgagcctcagcaagccaccccactctgccaaacgccctcccgcttatcataaagctcaggtcccaccactgccccgtggaaggcctcaccctcgcccagcctgacgggtgggctgtggttctgcctgaaaggtgattcactccaagaacctgctacgcagtggtaccctggtgggctccttcaaaatggacgtgggaaccgtgtactcgcagccaggtgagtacctgcgcatggccagtcagtcgaggtgtacacggctcaggagcatagtgcacagggcccttcccgctgtggcagttcctgggaaaagcctggcaaggaccacagtctgacgactgttagtacacacagccatctggcctgcggagaagtggcgcgcacagtctgtacacaaatgcagtgagcaactgcgcacccagtctggtgggttctcattcataattaggtcggtaactccacccagagcctggaaggagctccatcgcacgctcaggagcgcatggcaggctggcgcatcactggccataggcaggctgacgggtagtggtagagaatgcagtgagagaaacccgtcacagcctgcagaggggctgtgcctcctgggctggcacccgctgagcagaaaggaactcccttccacccctcacaggaccctgccatcccctattacagttgaggctcagagccagggcttgccccagctgcacagctggtcaggggtgaagtcaggctgcgtgtccccagagcctcgctgagctcactatccaatctgaacgcggtgatgctctcaatccagatgtagtgtggtggcctctgagggactctggtctctgaaaacacttcttacaagagccccaggctcttgggcagccatgtgggctccatggtgtcctgtaggccaacaccaatggggttggcaagggaaccccaatgggtggcccagagggcttgtgaggtgggccaggcagaggaagtgcctcagtctgccagatgacagctcaccccgtgggcaggttaggggccatcccgtgtccctgaagtgaatgcactgctcagagtgctgtaatgatcccattagtccctttgacaatgacaacataatttcacccaattgtcacatttgaccctcacaaaacagtaatgtaggcagcagcgtttcttcccattttgtaaatgagataaatgaggctaagagaaatgaaggggcttggagataccactaaactagtaagttgaacaaattggtgatcacttgtggtcaacctaagagatgtccgctggcacgcattacaactgtgactcagaccagggaatctaagtccaataccaagattatacatataaaaatcacaagatcatagaacactcaagctgcccaagacctgaaaaacatctagtccagcctctctgtgaggataaactgaagcccagggtgttgaaggggtttgcccaccatctaggagtagcacccctgtctccggctcccagaccagtacctttgccaccaccccacacatgccatggccctcagcagagggcagccctgctgaccgtcagtgctgtggggagcagggaagagtcggcctcctgccatgttgcttccctggaagcatgcatagctgtggaccacttgcgtggaatgactggcatccctgaggatgagctcctcccagggctcagcagtggtcctggtaccattggcgggcctgaggccaagagccaagagtcagggggtagagaaaaaggcagaggttagtctaatatggacctctgggcttctgggtagtaaagtcctggtgaggaaaccaccagggcatcagtaagtaccagacattgggctaagctcactgtcccagcaggactcaccctcacaaccccatgtaggcatcattcccatttcaccataaggaaactgaggctcagcaggcttaaagagctggtccagggccacactgtgaataaggagcagaaacaggatgtgggcccaggtctgggtgagaccaaagcccaggtctccactcaggtaacccagcttgagattcgctgctcctgttgaatccagccctaagcctggtgccctctcagggacagaagagcctgaagtcacacgggtcctagagttgagacccagtgtcttgactctgatgtctccagtttggctggggcttcttgatgagtccttggttccagccagggcactgttggacagcatgctctcagagacactcctgggtgctgctgggaagctttgggtggtgtcaatatctcttggaactggaaggggtttcccgagagacactcttctcaccctggcaggaccacatttgtcatttgtaccaccagatgcaacagcaggaaactgtttactctttgctactctctgttgggagtgaggatgggccatacactcatccttatagatcacagaggaagtctgggccatacactcatcctcatagatcaaagaggaagttggggccatagccgtacacttatcctcatagatcatagaggaagttggggccatacactcatcctcatagatcatagaggaagtcggggctatacactcatcctcatagatcaaagaggaggtctgggatgcagcaactccccaactgggctagccttgactggcaggtgtcagccccaggctgaagggaggtgaaatgatgtttcaggctggtaagcatatagctcagggtctcatgtggtccttgtatctctagcctgagatcacacagtattgagactagaagggcctcagaagtcatcagtcaagtgttaacctgatgtagggacccccacagcaccatctctgattggtcatctaaccttacttagtcctcccagaaatggggcactcactacctcttattttagatatcttcactttctttgggtcatctcaaaatctgttgccctgtaaccttcacccactttcacaggtctctctttcaggacaaaaagaaaaatagcctttaaatttgaaggcaaattttacattcctcctgaatcttattctctttcctttctaaatgtccccaattcatctaaccatgcacacctctatacatctaccccgtatccatccatccactcacccacccatctacaaatccatccacccacctgtccacagatccacccacccatccatgtatccatccatccacccacccactcatatatccattggtctacccacccacccatccacgaatccatccacccacccacccatccacagatccacccactcacccatatatccatccatccacccacctacccattcatatatctacccccccgagccatccacagatccatccacctacccacccatccacagatgcacccacccatatatccatccatctacacacccatccatatatctacccacccacctgtccagatattaatggctccttctatccaataatccatccaccatctgtccatctatctctcagccagccaggcagctcaccacccatccctctgcccatttctgcacccatttattgagcgatctgtctatctcctcatccgacacacatctgctctggcaagacctgaagttcctgggatacctgggacatggcccctaccggaggcctgccggcctggctgaggctctccagtgactcctcacccatgtgccttcctgccttcttgccttgcttgtccctctcttcagactctactgtggcattatcttttctgagacactggtggcctggctattctcagaaaggccaacctctgcacacagcccctaacatctctgggagcccaccagggccacaggcttgcaggacgcaggcctgggctacagtagaaggtggaagaggagggagtgaaggagggagtgaaggagggaggtgctgagtcccagagagttcggtgcccacagaacatcctgggaagcagattcctaaggcacagtgatgcgcttccctgtgcttgcccactgggcttaaagtaaacctgaaggagcaaatccttcctaaagtgcctccttccctgacatctgtccttccctccacacagtcgtaggccataggacactgggatgagactgccagtccctgtctttaggagactctcagtctaaaatcagagacaaacaatgcccagatgagcacagtgcacagtgagatgggaaatgtgcacagagagcacagagaacaaacaccaaagagcccaggatcaactcttctgagaaagtcagggagggctgcatggaggagaaacttgagcaacatgagtagaagtgtacaaattgaacagggagagagagagatggaggtggagagagcaggaatgagggcgttccaagctcaaagagcagcagatgtaaaggcatggaggtataaaagggcaaatccgcaatacatgttcagcaaggaggaacacaaggctgggtgggctcagcagagtgagtcagggagcactaaatcaggagcccacaggccgtgccttttgtctttaccccaaggcactgggaagccccagaaggagctgaagatggggagcaggagcatgagcctctccacctgggaaggccctgtgggcggctgtgtccttcacagctatgtgaaggctagctgactggggtggggccatagaagaggccataggcagaaagaacccaattaggaggaggctgtcgcacttccaagtcacaccactcatgggacgtatgtccatggctgggccatccacccactgccccagctccagaggacctcagactctatcaccccctggactagggacaggcagagctgtggtcccaggtctcgggactctaggggccaagagaacatttggctctgccaccccttggcctcccctgagcactgggagacgccctgggttgggggatctggtgcagtgctccccccctcaccactgcagagcaccagttccatcacaagtgggccatcctgtcggaccccgacgacatctcctcggggctgaagggctacgtgaagtgtgacgtcgccgtggtgggcaaaggggacaacatcaagacgccccacaaggccaatgagaccgacgaagatgacattgaggggtgaggcccagctaccccagcccctggagtctgagccagcccttccttcccccagggagttctcgatgagggtttgctcagagtacctgccacccatctccctcaccctgctctcgcccactctcccaaacagccccactcttccgaggcagggcaggggcagcaggtgatggaggatgactgagaataacagtcctttgacatcctttctgccagtgagaaatagggtgggaagagtcaatgctggcagaccagagccagcagctgctgggtcctgagtacagcagcaggatagtgctgggagagccccggtttcttctggtgtgccaattccaggcagctgatagcagctgttgagaaatattctgtgaccttgtctggagtcagtggatgaaagtgctgggatcaatgaatcctgtttttgtgagctggaggctactatgaagtttttgtttatgaaacaaaacttataggcacagtactataaaacactgatgataatactaagaccatatcccaatgcacaatctacaaagcactcatgtgttagcgtgcttgagccaaccatatacttgggaggtgggtactactacagccacctcaacagtgatgaaatggcagctcagtgagacgggagatttgcccagaattccacaaggggcaagttccatgaacgcaagtgtctcatcccagcctagctcccccagccgtcccttagactgtgccaggacccaggggtgtgtagatgccaggacgggggctggggacctggacctggccacaatggccctggctgtatgtactggcaggaacttgctgctccccgagggggtgcctcccgaacgccagtgggcccggttctatgtgaaaatttaccgagcagaggggctgccccgtatgaacacaagcctcatggccaatgtaaagaaggctttcatcggtgaaaacaaggacctcgtggacccctacgtgcaagtcttctttgctggccagaaggtactggggtatgaggtacaggaggcgggggctgggtgataggcatcacaaatgcaggctgatgggcatggggcctggggcagctgggcgggtaagaaaaggctggaaatcatgtcggccagggatgggcttagaggatcctccctgcctcctggagtccttagactgagagctacgcagggggcatgagagggaggagaggttgggggtgtgggaagggtgaagacaagtccacacacaggcatgcacgcacacatgcacccactcacacacgcacgcacacccactcacacacgcacacatgcacccactcacccatgcacacatgcacccactcacccatgcacacatgcacccacttacacagacacacacacccactcacacacgcacacatgcatccacttacacacacatgccacgccctcacccacgctcccccttccaccagggcaagacttccgtccagaagagcagctatgagcccctgtggaatgagcaggtggtctttacagacctctttcccccactctgcaaacgcatgaaggtgcagatccgagactcggacaaggtcaatgacgtggccatcggcacccacttcattgacctgcgcaagatttctaatgatggagacaaaggtcagcagcaggagactgggtgtgctggggggcagggagtggcctgaagggaaggagtaagtgagaccccctctcttcacaccaccaccatcaactccggacctcagcctcacatgtgcttccagggccttgccagcagcccctgcctcaaggggagggtgtggatttgtggctcaggtcggctcagagctggcctgagcccagctgattggatttgacagttagtagttgtgtgacctgttttcccatttttaaagtgaaaatagtaatgattatatgatacaataattatagtatgaataggcatatcattgcagtgtatatactgcatttgtatataattacagtgtgtatatatgtaatacttaatagtagtgcctatctgcagactcgaagggactgaccacctcctaggatccctgccctgtggtgggttccaaggacatagagtgagataagaatctattcctggatcaaagtgctcactgtgtattaaggagatagatgtgctaccagatggtcaaaacataaggcagaagacacaaaaggccacatgttgtctgatccatgtatgtgaaacatccggcaaatccagagacagaaagtagattgccggtttccaggtgctaatgggaggggattgggaccaactgctaaataggtgcagagtttcttatgagggggtggaactgttctggaattagatgatggtttttaacatagtaaatatactaaaaaccactgaaatgtacactttaaaatggcgaattttatatcatgtgaagtatatctaaatttttaaaatactataagtgtgttttttaaaaaaggcagaataaaaagcaaatgaaccaaaaaagccggatcttgcgacccctgtcagagtcctgacagatcttagccataagagaagggacttgtgcctaggaattgtgaaggcttcgtgaggaagcagcatttcacaggcacagatggacaggaagggaggggtctgcaccagcagggtgaccatggtgggacagagctgcaaaaatggcacagaaccgaaggtcatgctggggacttggaaggactagctccgtcctacaaatagactgttggcaattcctactccaagttgcaggaagcagaaagctacactctgcttccccgccacttccagctcaggcctccgcagggaagaaatagacccaagagagtactccaccccagcacagtataagaaggctgccccacatctgaataacacacatgaagttctcagctcagcacgcaggagctggaggccagggacccccaaaagaggcccctcttccccagggaaccctggatgtgatacggctccctcatttttctccccattgccacaggcttcctgcccacactgggtccagcctgggtgaacatgtacggctccacacgtaactacacgctgctggacgagcaccaggacctgaacgagggcctgggggagggtgtgtcctttcgggcccggctcctgctgggcctggcggtggagatcctggacacctccaaccctgagctcaccagctccacagaggtgcaggtggagcaggccacgcccatctcggaggtgagaccccaggcactgtgctgtcccccagggcctccagttcagcctccttccccccaaaacacctgggtcccagactttggcctgctgctgccctgtctatcggaggagtcagaccaaaggatgaggctcctcgccaggaagcagaggctcccactcagccccccaataggactctgccctcattcactgcctgtctgtgctctatctcacgatggccaccaggtctcacgacggtgccacccctccacccctcttcccagccatggctgtccctgtggtgtctggagccagccctgcttccatggatatccaggctggagggccatcggggtgtgggctgcctggccccaaagctgggtgggatgcccccaccatccacccccagggcctgtctgtgagatggaaggaggcctggcccccgaccttccacccctactcaagctcaagaatggtttgaactgcctccccacagagctgtgcagggaaaatggaagaattctttctctttggagccttcctggaggcctcaatgattgaccggagaaatggagacaagcccatcacctttgaggtcaccataggtgagtgctgggcccacggggggcttcaggcctaggtgagtgctgggcccacggagggcttcaggcctaggtgagtgctgggtccacggagggcttcaggcctaggtgagtgctgggcccacggggggcttcaggcctaggtgagtgctgggcccacggagggcttcaggcgtaggtgagtgctgggcccacggggcacttcaggcctaggtgagtgctgggcccacggggggcttcaggcctaggctgcaggtggtaagtgtgaggctctgcacctcagccctgtcctcattcctgtaggggatgttgacccctttcccctgagaggcctcaagcacccaagaaacacctttatgtgtgcatgtggtagaccatgctccataaaggggccgaccctcagctccacctacagggtgaggctgtgtttgggacctggggcagagggcgaggagaggcccttccctgggctgcagaggagagagtgggaactcaggccgcggcctgggccagggctgggcctccttgcactcaagtatcatcaggactccctgactctcagcagagtgggaacacgggcacctctctcgggctaatgctgtgtcacatccgagccccattccctgactctccctcttccttttcccaaatccaaggcagcaccgaattggactgtgggaggggcctgggggggaacacactctaggccttctgggcccgttctgcctccaggcaactatgggaacgaagttgatggcctgtcccggccccagcggcctcagccccgcaaggagcccggggatgaggaagaagtagacctgattcagaactcgagtgatgacgaggccagcaatggcggggacctggcctcagtctcctccaccccaccaatgcggcccctggtcaccgacaggtgggtccaacctcccatccccctgtggcctggccctcccacctccctgggcccccaagacctcacctcccacctctgcccaccccaggaactacttccatctgccctacctggagcgaaagccctgcatctacatcaagagctggtggccagaccagcgccgccgcctctacaatgccagcatcatggaccacatcgctgacaagctggtcagggccaggccaggggccagcagggctggggtcctgggggagagggtgctgtcagagggcattgcctgcaacacacaaagctggtctgcccaggctgcaggaatggccccagcaggacctctgttcccatcctcagccccaggtcccagggcacagacaagagcaggagccacctctagtcactgcagcctccagcgaaccccggggcaggagtgttgggttccctgatttttccagaaatcttaaaagcaaggctagggagacagttgtggtggctcacgcctgtaatcccaacactttgggaggccaaggtgggtggatcacctgaggtcaggcattcgagaccagcctggccaacatagtgaaaccccatctctactaaaaatgcaaaaattagcagggcttggtggcgagcgcctataatcccagctattcgggaggctgaagcaggagaattgcttgaacccatgaggcggaggttgcagtgagccaagatcgtgccactgcactccagcctgggtgactgagcaaaacttcatctcaaaaaaataaataaaataaaataaaataaaataaaataaaataaaataaaaaagcaaggctagggaagggaaatggggagaagggagaagcgagcagtgtctgaagctcaggagctgccccctcctcctccgcccacccctctccctgcctgacccatgggaactgactgggcgaggagcgcagctgttggcctgagacctccttctccccaacctgggggagcagggaccagcagataatcccacccttccctgagatgttgctgttccctgttgaagttccctgaagctcagccagctcatattttataaaaatgaattaaaacctccaaaaaagtcacagataatatgaggtttgctcccagccccctgccagtgtcctccttgtcacccctgtcttgtgactataaccacaattaaagcccacagcctttgcagtgtgacctgggcctgcagttgtctgcaaggcttcccgctaaggagtggggtactagctgacctgtgtctcctgtgggacctgggtctcccagccctcccagtgctctcagagccagagccactccctcttcccccaggcatctgttcccatgccctgccacaggccccagcattttggagtgacgtcaggatcctgggtttccctctgtctctggccagccatgagccccctgcctaggcctgagttctgcccaggccctgtgagcccaccagaaccacagactcacagtccacaggtggcttcttccttcaggaactgaagaacccacgaacaccaacatctccaggttctgagaacagaacttgggaaattgatgacttcctcataatgactgatactcaggacagccctagcaagagctcccagatcatgtggtccctcactcccctgatcaatggggaggagacatttaggaaggctggggaggctggggaggcggggctgtggcccagcatcactggcactcctggttcacaggaagaaggcctgaacgacgtacaggagatgatcaaaacggagaagttctaccctgagcgtcgcctgcggggcgtcctggaggagctgagctgtggctgttggtgagaagcggggggcggcaggttggggcaggacaaagcagaactggacaaaggggaccctgccagggctgggtagatgaggaagaatctacagagcccctgcttgtcaggctcgctaaatcccagctccccctatccccagccgcttcctctccctcgctgacaaggatcagggccactcatcccgcaccaggcttgaccgggagcgcctcaagtcctgcatgagggagctggtgaggacgcggctggaccgcagggactggagggagggcctggctgtgagaaggtgtcacagctgcctctgtcatggcccgagctgtcccccagtagctgggctccattgacaccccttcccacacaggaaagcatggggcagcaggccaggaccctgcgggcccaggtgaagcggcacacggtgcgggacaagctgaggctgtgccagaacttcctgcagaagctgcgcttcctggcagacgaggtgcggcccaaggcgagggggctttgccttatccagggttggctctctgaggtccttcaggctcaggggactcagtcaggaggctggaccctcttacccgttgcccctggccactccccaccccaccagccccagcacagcattccggacatcttcatctggatgatgagcaacaacaagcgtatcgcctatgcccgtgtgccctccaaggacctgctcttctccatcgtggaggaggagaccggcaaggactgcgccaaggtcaagacgctcttcctcaaggtgctggagggggcaggatggatgggggcctggatcctttcagaggagcagcagctccacctggggctggagggcctgagtgacagagtgaggccttcaagcagtaggtgctcagagaagagctgagaatgggaaggaggtgggggaaggggtgcggaaggggtaggacggccccctgcccatctccctgtctccactggaccccagcccagcaggatgctgtgaaggggcagggcagctctgaccagggcctccgccagcccctgccccttccccaccccgtgggccctggcagccgtcaggctcctggtgaccccatgcccacccccagttgccagggaagcgaggcttcggctcagcaggctggacagtgcaggccaaggtggagctgtacctgtggctgggcctcagcaaacagcgcaaggacttcctgtgcggcctgccctgtggcttccaggaggtcaaggcggcccagggcctgggcctgcacgccttcccgcccgtcagcctggtctacaccagtgagtgaggacccctcactcgaagcctcacctgggaggggccggaggggctgcccatcccagaacctcaggctgcccttccccacagagaagcagacgttccagctccgagcccacatgtaccaggcccgcagcctctttgctgccgacagcagcggactctcagaccccttcgcccgcgtcttcttcatcaatcagagtcagtgcacagaggtgaggccctcgggggagggagtggctctggctttgagagtaccgggaagcctgtgagcctgtggggcctgggacctgtggagcctgtgagcctgtggggcctgtgagcctgtggggcctggggcctgaagcctgtggggcctgtgagcctgtggggcctggagcctgtggggcctggagctgtgagcctgtagggcgtggagcctgtggggcctatgagcctgtggggcctggggcctggagccctgtggggcctggggcctggggcctgtggggcctgtgagcctgtggggcctggagactgtggggcctatgagcctgtggggcctggggcctggagccctgtggggcctggggcctggagcctgtggggcctgtgagcctctggggcctggggcctggagcctgtggggcctggggcctggagccctgtggggcctgaggcctggagcctgtggggcctagagcctgtggggcctggggcctgtggggcctggggcctgtggggcctggggcctgtggggcctatgagcctgtggggcctggggcctggagccctgtggggcctggggcctggggcctgtggggcctgtgagcctgtggggcctggagactgtggggcctatgagcctgtggggcctggggcctggagccctgtggggcctggggcctggagcctgtggggcctgtgagcctctggggcctggggcctggagcctgtggggcctggggcctggagccctgtggggcctgaggcctggagcctgtggggcctagagcctgtggggcctgtgagcctgtggggcctggagctgtgagcctatggggcctggagcctgtggggcctggagctgtgagcctgtgaggcctggggcctagagccctgtggggcctagagcctgtggggcctgtgagcctgtggggcctggggcctggagccctgtggggcctagagcctatggggcctgtgagcctgtggggcctggggcctggagcctgtggggcctggagctgtgagcctgtggggcctgaggcctggagcctgtggggcctagagcctgtggggcctgtgagcctgtggggcctggagctgtgagcctgtggggcctggagcctgtggggcctatgagcctgtggtgcctggagctgtgagcctgtgaggcctggggcctggagccctgtggggcctagagcctgtggggcctgtgagcctgtggggcctggggcctggagccctgtggggcctagagcctatggggcctgtgagcctgtggggcctggggcctggagccctgtggggcctagagcctgtggggcctgtgagcctgtggggcctggggcctgggagcctgtggggcctggagcctgtggggcctggagctgtgagcctgtggggcatagggcctggagcctgtggggcctgtgagcctgtggggcctggagccacaggtcagccagtgccctagtttctcaggggaagccctgcagataactgtagacccgggtcacaccggaaaggctacgggctttaattgtggttatattcacaagacagggacaacaaggaggacgttggcagggggtttggggcaaaccttacactggccttgattttaagatttctggaagaatcaagaaatctgtcactcctgcccccaggttctgtggaagttgagtgagtaggggcagctcctgttcttgcatctgcccaccatctgtcacttgtcacctgtctccccaccccatgctgcaggtgttgaatgagaccctgtgtcccacctgggaccagatgctggtgttcgacaatctggagctctatggcgaagctcatgagctgagggacgatccgcccatcattgtcattgaaatctacgaccaggattccatggtatgggtgggctctggtgccagggacctcagcagcaccacacctggcccttgttccctgcactccacctgcacggaggctgtgccggctacctccgccacccacccgcagagttccttggccaggtgctgactgggaagctgggagtgggggctgacacccagtccctccaggtgcctcctgccagcttgcggcagcctgaccccttcccaggccaggacatcctcacctcctgtcaccaatggtccgagccctggagatgtgctggcaagtcctgctgtcactagcctcctcaccccggggcttcccgaaccccgcccacacttaccacaaccagtaacagccttgccgtcctccgtggagattctggagtaggaagtaagggattggggtgactcccgagagttagtgagccaccttctcacgcaccacctcagctgcggaggtgccagatagccctggactagacgtaggaggacatcatgtctagtcctgagccggacatctgctattcactgactgcttggccttgaacaagtgtttggtgggccctgagacttggtttccccatctgtaaaatgcggtgatcacacctgtcccttacaacaactcatgtggctgtggtaaggactaaacgagatcacaggtgtggacagcaagcaccaagaggcatctgggttgtttgctgtgtcagggcaaagctgacttcatgggccggactttcgccaagcccctggtgaagatggcagatgaggcgtactgcccaccccgcttcccgccccagctcgagtactaccagatctaccgtggcaatgccacagctggagacctgctggcggcctttgagctgctgcaggtgggacacagggaagagaggctgaggcctggcagctggaggctgggaggaggggcctagggctggtggctggggcctggggttggggcttgggggtgggacctgggggttggagtctgggacctggaggctggggcttggggctggggcttggggctggggcctggggctgggggctggggctgagggctcggacctggggcctgggggttagggcctgggggttggggcctggagctggggtttaggggtgggccttgggggtaggacctgggggtggggcctgggggttggaggctggggcctggagtctgggacctggaggctggggcctggggctggggtctgggactgggggctggggctaagggctggagcctgggacttgggggttagggcctgggggttggggcctggagctggggcctggggcctgggggcctctctccttcccatcctgaccgaagctgggggagtggttcttggggggttttccctgtctccccagatctcatggcaaacaatgcatggggagagagaccctgtccctgggctccccagtgtgtgacctgtgacccccattccccagattgggccagcagggaaggctgacctgcccccgatcaacggtccggtggacgtggaccgaggtcccatcatgcctgtgcctgtgggcatccggcccgtgctcagcaagtaccgagtggaggtgcgagggccctgtgtggcctttctctttcagatgaggaaactgagggcccaggaggggaagtggtttctcatccccctcccatcaccatcaccaggagccagcagcagactcaggctcctgccccagcccagggcctgcccccgtctgcaccaagtcgcactcccatgtcccaggaccgtgcccagccctcctgtctgcacccctgactctgcaccccttctctgggcagccccactctcatctctggaggatgcccctcctctgctctcctggccctgctccggccctttgaaatctggggtgaacttctgcccatgctactgcccagttccttctcagatggtccagcgcccctacagcggctcccttgactaaggggctctcttctctgcacgcccctcaacctctcccaggtgctgttctggggcctacgggacctaaagcgggtgaacctggcccaggtggaccggccacgggtggacatcgagtgtgcagggaagggggtgcagtcatccctgatccacaattataagaagaaccccaacttcaacaccctcgtcaagtggtttgaagtggtgagtgcaggccccggcggaggatgtcctgtggccagtgtggctccactcagccagccggcttcctctgccccttctcggaggctcaggctcctgtcaccaacaccccaggacctcccagagaacgagctgctgcacccgcccttgaacatccgcgtggtggactgccgggccttcggtcgctacacactggtgggctcccatgccgtcagctccctgcgacgcttcatctaccggcccccagaccgctcggcccccagctggaacaccacgggtatggccacacccaccctgccaccaagcctggctccatgccacccagggaagggctccaggtctcagtccagtccaagctgtggccagagtttgctccttgggtctgagggatggcacagaagaaggtccacgctggtggccaaggaaggctgcccagggcgaccccagctctacggccagagagggcagagctggagacagcctgggagggcctgagggcacaaagtcccttgtgctggctgatggagaagacccaggcctctctgccgcctacctcccgccggcctccacagctcccccttctcttgggctctcttcctccctccccatgcccatctttcctcacttgactgccctgtccccctttccctcagaaagttccagaatcagctttagttctctgcaccttcctgccccgccaatctcactgttcctcttgctccttcctctgcctgtctgtccatctgtccatctgtccagtcaggcttctccggcgttgccgtgtgctgtgcaatgggggcccctcctctcactccacaggggaggtcgtggtgaacatggagccagaggtacccatcaagaaactggagaccatggtgaagctggatgcggtaaggcgggtggggtcagtcccccgctggctgggaacgtgcaacttcatgtgacatgtcctgtgaaccagactatctgccctgagagagaaggacactaagaacctcctttggcatgtgactgttgggggctgaccttgattgtgtgtccaaccagctccacctaacactatcctggaatgcacgtgcctgcgtgcatgtgtgtgtgtagtgtgtaaatgtgcatgagtgcgtgcatgtttgtggtgtccatatgtgcatgtgtgcatgtatgtgcatatgcatgtgcatgcatgtgtgtggtatgcatgtgtgcgtgtgtgcatgtgtgcatgtgatgtatgtgcatatgtgtgtgcatgtgtgtgtggtgtgcatatgtgcatgtgtgcatgtgtgcatgtggtgtgcatatgtgccttgtgtgtgcatgtgtgtggtgtatgtgcatatgcacatgcgtgtgtggtgtgtatatgtgcatatgtacatgcatgtgtgtggtgtatgtgcatatgcgagtgtgtgcatgcatgtggtgtgcacatgtgcatgtatgtgtgtggtgtgcatatgtgcatgtatgtgtgcattgtggtgtacacatgtgcatgtatgtgtgcatgtgtgtggtgtgcgcatgcacatgcctgtgcatgcatgtagtgtgtgtacatatgtgcatgcatgtggtatgtaaatgtgcgtgtgcatgcgtgcatgtggtgtatgtgcatatatgtgtgcatgcatgcacgtggtatgcatatgtgcatgtgtgcatatgtgcatatggtgtatgtggatatgtggatgcatgggtgtaaatgtgcatgtggcatgcgtgagtgtggtatatttgcatatatgtgtgcatgtgtgtgtggtgtgcatatgtgcatgtgtgcatgcatgtgtgtggtatgtaaatgtgcatgtgtatgtgtgcctgtggtgtatgtacatatatgtgtgcattcgtgtgtgtggtgtgcatgtgtgcatgtgtgtgtggtgtgtaaatgtgcatgtgtgaatgcatgagtgtgatgtgtgtgcatatatgtgtgcatgtgtgcttgcggtgtgcatatgtgcatgtacacgtgcgtgcatgtgggtgcatgcgtgtgtgtgcgtgcatgtgcactggcatgtggtatgtgtatatgagagacagagtgagccatcacagtttattataatcacctgccataatttttactccaacaaatgacaccataggtaacgattccttatgagatcatcagtgtcctttccaaagggtccttgggttttccattccagccattcacaaatgacacttccctgggctgggtcggaggaggatttccaggtggaagctccttattcctcctggctttcagactaagacccttcatctgccagagagagacctaccacctgggggttgggtgtggaagtggcctacacgctgcagaccctacagggaagggcagaacatgggccagcctagaacacacccccttgttcctttggccacccaaagaaacatcctcactcagaccctttgcagactcaccagtcagaatgctattattaaagcaaagttgaccttgagggcacaggggctgccagcacacagtaatttccatctcggctcctccacacgccctgtattgggccactgcctgccactccaggccccagtgactaattctgcccctgtctccttggttcctctgcagacttctgaagctgttgtcaaagtggatgtggtgagtgtgggggccatgcaggggctctggggtgagagggtcctgtattggcaacggtgtcaggtcaaagggtccagcatcagggacagagccagcccccgcccccgcatgattgggccagcacatctcccccaagatgcagtgaaaaagagctgggtgagtgcaggactcagtgccagtcctgcctgggccagtggatcacatgggcaggtcatgaccctctgtggcccatggcacctcctccattaaacaagaccctgccccttggacataggtggccccacagagccttatggagcccaaggtttcctgctagcagatgacggaatgggtggaggccctcgggattgtccaggcaggaggggcccatgtaggactctggacctggccaacctacaggctgaggaggagaaggagaagaagaagaagaagaagaagggcactgcagaggagccggaggaggaggagccagatgagagcatgctggactggtggtccaagtactttgcctccattgacaccatgaaggaggtgagacctcaggcagggtgaggggaggcgaccccctccacactcagaccctcctgtccagcttctttcccacagcccccggagctgggtcccacctccattcatgtgagcttgggatggccttgtctcacatccttgaaatcctagctcagaactcaccttccaagatgatggtcccatctgccttccctggcttagtttccttttgtcctcattgactcattccacaaatgcctcttgggtatatgcgatgagccaggctccatactaggtgctatgggagccaaaagatgccatacctgccctgatgggcccccggtttactgggcaaaatagacatgtaaacagagacttagaggactatgtgataacaaaggcaaatcatggcttgggggaatcagggaaggcgtccaagaagtgacctttgtgaaaaaggagaaacatgttctcagaggccataagggaacaaatgcttttcagtagtccttacgactcttcttcatactgttttattttacacatcttggtcatcggcacgtgaatgattcttcccctgttacacatatgtgggttccatctgttggccagattgcaagtcccagaaagtgcatttctccgctctcttgtttgtgtcctctgcctgctgcctgcctagctcagtgctctgactggccacctgaccaggaagggcacatgcctgcagttgtgtttccttagtggggctggagctgatccagccacattctctcccaggccctttctgcagcctaagctgggtgtgatatttattagagcacacattaagctgctgtagcaagttagagtgacgtaaacaagacaacagtttctttctcacatagcatctcagagagtgggggttaggctggtatggtggctcagtggtgtcaaggactaagatcctgacctcttgtttctgacatctgtagagttggaggtgactcaacatcatgttctaattcaagtgcacaggaaaggttaaagaggagaggaggcatatgcttttctctttcagggcccaatccagaagttgcgcatatcacttccactcacattgaccagaatctagtcccatagctacacttatctgcaaaggaggctgagaaatgtaatctttagcaaagtgactgtgtgcccagcaaaacttctaaaaaagcagaacagatcattgaggacaactggtagtctcttctcccaccatcaaattggccaggctagagctgcaaaaggctgcctgttgtcttgtctctactcctgcaattttcacagactgccaccaggtggcggtggcgacttaattgaaacccggtttctagttttcagtaagatttattctcgtttccagtagggtggggtgtgctgagtgaaagaaaatatagtacatgttcttactgttatacttttctacattaaaacaatttattaataccactaaaagcaacattaaaatgcactgtattttttaagtagaaaatataaatatttattgcaaggtattgttttttttattattattatactttaagttatagggtacatgtgcacaacgtgcaagtttgttacataggtacgcatgtgccatgttggtttgctgcacccattaactggtcatttacagtgggtatttctcctaatgttatccctcctctagccccccaccccctgacaggccccagtgtgtgatgttcccctccctgtgtccaagtgttctcattgttcaattccctcccatgagtgagaacatgcagtgtttggttttctgtccttgtgacagtttgctcagaatgatggtttccagcttcatccatgtccctgcagaggacatgaactcatgcttttttatggctgcatagtattccatggtgtgtatgtgccacagatgcataaacccctaagtaccactagtcacattgtacaccttataaacttctttaaatcaacttaagcagagcacatggtggatttgaaatgcagtggggaagattttctacttctagtgcattaagactggtctgggtccacagtttggggtcaacagactcctccccaggaaacccaccttctctcctttgcatctcatcttttggcagcaacttcgacaacaggagccctctggaattgacttggaggagaaggaggaggtggacaacactgagggtgagccctggaacctggaactctgcctcctcctccccgccccgggtagctggctctcctgcccacctcaccacctgcttctctttcccctcccgccagtcctcccagccttagtagccagggaagcagcatcagtagtctgtgggctctgagcaagctaaggcccttgtctagggaggcttttactctgaccagttcagcacccacggtgatagacagacatttacagccacagaacatcagagctggaagggacctcagagctcattccatccagcattttccagactcttttccatgaagaaaattatgggtgttctaaaaggaacaaattagttttggtcaaattagtttaggaaaagctgattgaaacagcttattctggtgcaggacttttcagagcctttactgtgcaaatgttattatacatctctaaaagaaagacacagtgtaaaatatttccccagcttattgggtcacagtaccctttcttctaaagcatgccagcagcatctgcacctgttgctccactgcatgcagtttgggaaatgctaatacagagtgttattattatggacaagaagagggaagctagtaaggaaagtgagtggggaaggaactgagtggcaacaggcctccacccccaaacccatgctccttcctgcccctctcttccaaagggcatgatgacagtcttcagacaccttcccaggcataaactcactggggcccccagcacctccatgaggcgggcatgctaggaagtattatctgcatttgacagcacatggacatccgagagttaagttagtaaagcaaattagcgacagagctgggtctccaatccaagccttcctgctctgctcatttctgctccacctccttttctgcttctggccaggcctgaaggggtcaatgaagggcaaggagaaggcaagggctgccaaagaggagaagaggaagaaaacccagagctctggctctggccaggggtctgaggtccctgagaagaagaaacctaagattgatgagcttaaggtaagagcctgggagcaggtccttctagggagtgcgggggcgttggcggggtggtggcggtgatcctgcaggtggggcaggatgaaagccagaaaccaagcagccaccccccaacggcctggtctggctcaggtgtaccctaaagagctggagtgcgagttcgataactttgaggactggctgcacactttcaacctgcttcggggcaagactggggatgacgaggatggctccactgaggaggagcgcattgtgggacgattcaaggtcaggccaggagcacgggcccagcccctgagtacccctcagcccttgccccaccacaggttctcccactcacctcccaccactgccctggtcactccctccagaagccctggactttcccatgactcaccagctaaagggtgaaggccctgccacatcagggtccagccctcccggtgccattagctacttcgaatgccacccctgccaggcaaacctacagcctgacccacatttgtcttgcccagggctccctctgcgtgtacaaagtgccactcccagaggacgtgtcccgggaagctggctacgaccccacctacggcatgttccagggcatccccagcaatgaccccatcaatgtgctggtccgagtctatgtggtccgggtgagactcccgtcgcttcccctccttgcaagtctttcatcctcccatctgagagggaccaaagaagctgcatactggctgggtgcactggctcacgcctgtaatcccagcactttgggaggccaaggcaggaggatcacctgaggtcaggagttcaagaccagcctcgccaacatggtgaaaccctgtctctaccaaaaatacaaaaattagccaggtgcagtggcacacacttgtaatcccagctactcaggagactgaggcaggaaaattgcttgaatccaggaggtggagcttacagtgagccaagatcacatcattgcattccaacctgggagacagagtgagactctgtctcaaagaaaaaaaaaaaaaaaaaaaagaagaagctgcatactgacagccccagactgggaggcaccagggaaatcatttggtctagcctttatcttttctagaggaggaaatcaaggcccagagaggggtagccacttgcctagggtcacagagcaagcctcctgacaggtccagtgttcctgcccctgcccttcactgtcataggaccctcaggcagcctggcaggagcactgaatatgagcagggcatgggagcctgctcaggcagccctcctccccatcccaggccacggacctgcaccctgccgacatcaacggcaaagctgacccctacatcgccatccggctaggcaagaccgacatccgcgacaaggagaactacatctccaagcagctcaaccctgtgtttgggaagtaaggcttcttggtgccctcccctgccacacaccccaacttctccaacccagaccacctctcaccctagccgatccttaaacccttctaactccacccccaccaggtcctttgacatcgaggcctccttccccatggaatccatgctgacggtggctgtgtatgactgggacctggtgggcactgatgacctcattggggaaaccaagatcgacctggaaaaccgcttctacagcaagcaccgcgccacctgcggcatcgcccagacctactccacgtgtgtggggcgtggggcagagggtgggggcagtgtgcctgcttcgcctccactctaaaatgagattcagattgtggtgatttgagaaggtagaaatattgtggtttctgtcccaggccaggcctctgcccctatagtccctgggcacagccttcaggggacaggactgcagatcccaaaacaaggagagggccagtggattgcaggacagcggaggcaggaagaggagagacaagtgggctagggaaggtgggggccagaagaggaggacaggaagagtccccgggggatctgggccagctctgccacttacaggctgtgtgaccctggccaagtcccttcacctctctggttttcagtttcctcaagggagtctctgaggttccagaggagtgggcacagtgaggggatgcagtggggctaggctggggacactgatacgtggtcgaagggccaaggcaggagggttcaacctccagcagccctagtgtctcaggtgagcctggggcccagggcaggaggaatcagactcacttgctgatgagggcaacagccagctttagagaactggccacaaccagctgtcatccaggatggcttagtcctacccagcccctccaagcctgtgtgtcccctcccgcagacacggctacaatatctggcgggaccccatgaagcccagccatatcctgacccgcctctgcaaagacagcaaagtggacggcccccactttgggccccccggaagagtgaaggtggccaaccgcgtcttcaccgggccctctgagattgaagacgagaatggtaatggggcactggagggggacgcagccacctgccccctctccagcaggtttcagagaccaggaggggtccacacttccctggggaaccccacagcctagcctggggtgtcctcagcctaagcctgggcttagtgaccctctgctcatcaccccagagccccgctcctgtgccccgcctctgtgcttccactcctcctccagggcagccccacctgctttctctctgtccaaatcccagggaggtagagaggctatctgcatcccattctgcagatgaacaagccaagatcctagttccagtgacttgcccaaggtcatgtggctctttagaggcagagcaagggcaacggcccaggtccatccggctctaatccttaaactctccttactcctctgtccgtgaggcacgtcccagagaagcagagaatcgggaggtgtccgtgctggtatctgatcactgtcaggtgttgggacaggaagtggattctcccctccctgacccctctctcacagcccagcagggctctccagtcaacttccccaagcagaggaccaagggcacagacctctcttggccctgtggggcagctgagaccctgggcaagccacttctccttctatgcctcagtttccccaacagtgaaaaggaggtggggtaaacaggtgatggcataggggcttctttgtgctcctaaatccctagtcccagcaaaggtctcctggttgtgctgagccatatgtgcagctgagctgcctgtacccacaggtcagaggaagcccacggacgagcatgtggcgctgtcagccctgaggcactgggaggacatcccccgcgcaggctgccgcctggtgccagagcacgtggagaccaggccactgctcaaccccgacaagccgggcatcgagcaggtgacacttgcatggccaagactgggggtcttgggtattggagaccagggattcccaagctgagtcagtaaaggtagaagccaggcctcatgctgtccactgcattccagaaagcctggcaggcacctccccaccaaggcccctcagggtaacttgaatggcaagtgtctttgctttgagtgagaattacatcagctcaggcagagacctaggttgtctccctcagaagctgtgattggctattggtgacatcataggaattcctggcatccaaagatggaaactgatgaactgggtccttgacagaacaaaggttaggagggagaggagagctgatcttcctgggcagagggagaagaccctaggagatctgccacaaccctcttcctcagggccgcctggagctgtgggtggacatgttccccatggacatgccagcccctgggacgcctctggacatctcccctcggaagcccaagaagtgagcgcctcagggcccaatgctactccctcccggcccaccccatcacttcccaccacggcccaacccttcctgtgggaggctcaggcccagatggccttggccagttggcatctctggggcctgggtgtggccactgggccttataggggagaaactgatcaaccaatcaatagagtttagggcctgccctggagagtccccatgcgctaaggcaggacaatgccttccaccctgcgtcagtgagggagatgagccctacacagcacactccggtgcactgcatctgcgtggtcgacgcacccatacacatgcatctcgtgcacacacacacacgcacagcatagcactcccgtgggcactcacacacatgcccacactgacgcactccttcacaacacacagaacccctgggtcgtcctcacatccaggctagtgtgatgttccgccgagttttcttgaagtgcctgccagtaacgtatgcaggagtgagtgcctggaagaggcaggaggtggtggcgtgaaaagaacgcaggtttcccatccgtaaagcggcagattcgagtccagctgccagacagtgactggattcagggacggcttcagggatggaggaagccacacagggtcccactcttgtttccattctcctgtgttgccatcttgaaattctttgtgacaagtggccctgcatttccatttggcgctggccccggcaaatcatgcagccaattctgccaggaatgtcctggaaacctgaggccatgagtcggctgttcagggcctgtcattagggagcacccaacccgctgggccactctgggctcgcggccctgtctgcaatcccaggagagccaggctcggatcaatttttagtgaatgactcagcctcactgttaataattgaaatgaactacatcattcataatgacaattaaaccttgaggggaaaatcctctttggggacaaggacatacagcttccatgggcttcctttgctggctactgggcttaaatgcagacttctcttggaactagcatctgagacagaggctggcttcccgccccctgccccacgccacccccaccgcccacagccatgcgcctggtgggccctctcactcatgcctctgcttcccccaccccgaaccactctagccccagcctggcccaggccccgtgctgaccccaagtctccagggctcctctctacctgccccatcccagccctggcaccctggcataacccccacccgggtctgctaaccagctctctctccctgggcccaggtacgagctgcgggtcatcatctggaacacggatgaggtggtcttggaggacgacgacttcttcacaggggagaagtccagtgacatcttcgtgagggggtgagtgagcagtccctgcatgagagggactgagccgggcaggccctgcttcccggggggcaggaaaggaggcagagggaaggtggctgtgggtgggagaggtcccactggcctggctgcaggtctggagatgtggcgcccacaggtggctgaagggccagcaggaggacaagcaggacacagacgtccactaccactccctcactggcgagggcaacttcaactggcgctacctgttccccttcgactacctggcagcggaggagaggatcgtcatctccaagaaggagtccatgttctcctgggatgagaccgagtacaagatccccgcgcggctcaccctgcagatctgggatgcggaccacttctctgccgacgacttcctgggtgcatagcagggcagggatgggggctcagaatccagaactgaggaggggcaggggctggggaggcaaggacagggagagccccgccctggggggacaaggacagggagagccccgccccggggggacaaggcgttattgcttccggcctgtcagagccagggatgtctgacggggttccgcccccaaggacccacctaaccgtccccaggcagatgtccttagtatcataaccaggctgaccacaagctttggacacaccaaggagggggcagtcagtgctgatgggggaggggagaggctccctaagggagtcgggaaacctccctgggcctcaggttgcttctctgtaaagcagggattccccctaaaactctaatctgcatctgcaagcttgtgggattagcaggactttgatagaatggatgtgtggcagggagtggcaggggagaccccaggagagaccctctggggtgaaagaaggacctgagtaaagcgtgggggctggggctgcccagcaagcccacgaggacacctgcattgaggccagttgctgggagtgaggcaggaggatgagatttgggctcctggaggtctgcactcagcaaccaagggaacgaggagcccagacccccactcccaccccaccccaccccagccctgttcactcagagctgacactgaggtcgccacaggggccattgagctggacctgaaccggttcccgcggggcgcaaagacagccaagcagtgcaccatggagatggccaccggtgaggtggacgtgcccctggtgtccatcttcaagcaaaagcgcgtcaaaggctggtggcccctcctggcccgcaatgagaacgatgagtttgagctcacggtgcgcaccccctcctgctcgggcagtaggcagggctgggcccagctggggtgccaagggcccagcacgtgacttggacactggaacctgtctgtcctctgcagggtaaggtggaagctgagttgcatttactgacagcagaggaggcagagaagaacccagtgggcctggcccgcaatgaacctgaccccctagagaaacccaagtgagtgccctgcctgcccagcccctccccactctggttcttggaggcactggaacaggaaggagacactcctcagacaccccatctcttcctgggccacagcctcattacaggggagcctcctccctgctctctgctggccctgaatcccgcaacgtccctttgaaccagaggatgggctaggagtactggagagcaggacctttcctgggaaaggccccatttagcagagataaactacgctcttcccttcctagcttttgcagaagagccagctccagtggtggcctctggggcctcggccagccttgatggccagagggatgcctagaactgcacacacagcccagggcagcttccctcttggtcagggcccctcgctacacccaaccccttctcctccctgtccctcctctgcactctctacccttcatgctccagccggcccgacacaagcttcatctggttcctgaaccctctcaagtcggctcgctacttcttatggcacacgtatcgctggctgctcctcaaactgctgctgctcctgctgctgctcctcctcctcgccctgttcctctactctgtgcctggctacctggtcaagaagatcctcggggcctgagcccagcggcctcctgggtctgatacttctcacttcttcctctggaccaagggctaggcaggcgcgcgcacacacacacacatacacgcacacatccacaaacacaaatgtgcatacatatgcacacacacacaagcatatatgcacacacgtgccacacacaagtgcatacacatgcactcaagcacacacaggcacacacttaagcccaaacatgcacagcaactttcagttttcatgacagaatagactctcagaactagaaatgactattttacactttcccatattaagccagagaggtgaagtagcttgctcaaggtcacccagcaaattagggtagagccgggactcaagccaaggtttccaaattgccaatcctgtgttctttgcacaccacctctgctcccagccacgtttctcccagactctagtccaatttcattggcagaaagaagctgagctatggacagagaaaagggaagggtgtggccagggttagccaacaggtctggaaatggctctcaccagtgtgtgacctcccagtccagggctgttttctgcccttcggaatcatagttccattcagctcaaacatttcatagccaccatggcctgaacacccactgcaggtgcttagagttccccaggcactggctcactgtgccattgcaccaaccccaggaggtaggtactgcttgtaaccccattttatacatgaagaagccgaggttgatagaggtgcctaactgacctgtgaaaaccattcaaaaccaggcgctctgcacccaagccccagctctgtgtccccaccaatactgagctcagctctggggctgcacgccatgtcctctgggaggcagtagtttgaaaaggcatattcagtactttcactctgtatcttgacattttaccaaacctattgtttttataacacaaaagacagatagtgaggctggctaggtgcttctcggctggcaggctctgcggaaggtggagtgggtctgcaccctgacagtgggaaggtcggtgagggcggcttgtgccccacaggggccgctcagaccctcagcagggcccggtgggagcagccatttacgtccatcagaaaggaagaggttgcgaaacaccggtctcacgaggacatggggcagcacatagaacgagctaaccacaggagcttgctaacgatgagaactgcctgcagggccaaggctgccccatgctgcaagtagttcccatcaaggccttgggagcagattccagctccaaaggtcctgcagagaggatagagttttgtaagcagcaagtcgggtacttagaaatgggttcaaaccctgcctccagcattcactgcttttggggctggggccatgacagggcttttgggggtccagaaggacagaggatggggtgcactgggaggcagctcctgcccactggctgaccggctcctctcttccacttcccagccggcccgacacagccttcgtctggttcctcaaccctctcaagtccatcaagtacctcatctgcacccggtacaagtggctcatcatcaagattgtgctggcgctgctggggctgctcatgttgggcctcttcctctacagcctccctggctacatggtcaaaaagctccttggggcatgaaggccgccagctcccgctagccactccctggccctgccacatttccttgcagtggcttggactctttcccatctcccctgggcagcctgaggagcccagtgtccactcttcatgccttgggcccagagcctgcctcctgtttgtggggccgcctgtcctcactgccccaggctgcggcttgcccagtcctgcccctctgacccctgcctgtaggctggggagccttggatggggtgggaacctggaatgggtctatcttgccccatctggctgaggcaccacacttcttcaggcccaggctccagaggaagcctcctgaaaccttccccaggtcttccaagtacaggattgaagctttagtgaattaaccaaggaccaggggtcagtacccagagctttgaaaagaatgaacgagcaaaaggtatccccgccgtgtccccttcagatagcactggtctttgatccgcaacaggggccagaccctgtccacaagtcccagggtggctgtgctgtcactgctgggctccacttggctcctctcgcttcccatggcgttgcctgtcctgcctgtgcatttccatagcttccagagcttcctctgccccagccagtgcccccaagcccagctgaggagctgtgaggagcagcagaggggactccccatcctgggcacaccctgccctcccacccctgccccccttgcccttccagccctttcagctgcagctgggagctggcccatcaagtgctgcccctgcctgtgtctgggtttctgttggctgtttttcttgagtggtgatttttctctaaataaaagaagtcaagcactga

SEQ ID NO: 18 - DNA, 100960 bp, Canis lupus
  source 1..100960: mol_type = genomic DNA
gatcttacaccctggaagaaggggttggagtggaaatctcagacactttgagagaaaggccaaagaatggaagagacagtcagacttgcatcttggatgtttggagcttgataacagccagtgaaaggaaaggtaggtttgaccctgcatctgaaaatgtaaaaggttaagacagatctggggacccagaggcattcaaagccagcatctgtgacgattaagtgagatggggtgggagtggggggtaccgaccacaaagtccaggggccctgcactccactgagaaataactactgcccgacccgccttgccagattcttcgagcccaccccgggggcccacccggtctctccttttgtccttcaaccgacaaagatgactcttgagcgaatcctgggtgcggagcactggtttggggcccgaaaaccctgctcccttctcgggcgccccacgctctcgctccccccgcccaggggtctccaaacaccaacctcgcgcagcggctccctctcctcccgctttcccgcggcccaggctggggggggagaacctggagagccccaggccggccccgccagggctgctcggagcgcacgccagccccgggaagacggcggccggtgcacgggggcgcgcagggcggagttgccagcgggaggaggggtctaggggtggggggaccccgaccggcgggagcggccttacccgggcatgaggccgggaggcacgtaggcggcactgaactcgctcagcagcgtgcccgcgctgcgggaggccatggtgggtgcagcgcctccccgcccgacggtcaacagcccggggcacctggcaaccgcgcgcctggcaaccacaggggccgcgcggccgccgcgttcggggggcgggggggggtccctcctggcgcctgctcgcctgtggcccccagcggctgcgttcacgtccagggatgatgggctcctctgcttcgccgcccgcccgggatgcggtggcgccgggatgcgggatggaggtggaaactcgctggagaggccccgggagtgtgccccccccccccccccggtccgccgcaggcctcgcccaccccgcctggggcgccctggctgcggaggccgagcagaaagcagcagccccatcgccgccctgctccaggagcccaggaggccgcagggaccccaggagccagcgctcgggcaccccagtcccccaaggggattgtcttcattgctctctcacctctccctgggagctttcttctcacctcgtcctgcccggcaaactactctacaagagtggtttataagtaaggggcaaaaaacaaaccctggaaacgtctgggtgtgtgatttacacctgtccccagttctgaagtccagtccacaaggttagctggtttgcaccccaactggggatagtggagagcaacctcccgggtgaggttttcttgtaatgatgcctccctcctgtaactggtgcccctacatcccatttctccagtgaccctcatctcagccctggtctttaactggggtgtgagagagtggtggcagcctccaaaggcaacgtgttctttgccacttggagccaaacctgcctcccagctcccttgcagcagtgctagtatcagtgagagccccctgcagtttatcctcggccttcacagtttcactcaaatcctgtcggaggagaggtgttatcttcacagtttgactctgtgaatggcagctgatgaagaccatagacactaatgagcttgcaggatgcttttgccaccagaattctcaaaaggcttcctctgacagttaacagtggaagccacaggcttccaagaggtgcaggaagcaggaaaacaggcctagggaggaaaaggatctgaaggggaatgagtggttgcgggccaggcagaaggactctccaccacgccttcaaaccgcagagagatctgtgtatttctaaattctccatgcagggatccctgggtggcgcagcggtttagcgcctgcctttggcccagggcgcgatcctggagacccgggatcgaatcccacgtcaggctccctgtgcatggagcctgcttctccctctgcctgtgtctctgcctctctctctctctctctctctctctgtgactatcataaataaataaaaattaaaaaaaaaatctaaattctccatgcagaatataagcaataataagaaaaatgttgtaaaagttgtgaaagaacaaccctcagttcaggtgtactatactccaggaagagatccttcccccttgcccccgccaacgtcaagcgcccactccccccctcatcatgagttcccagctgactatgcccctgaacctggcaccttgtgttccagtgaatatcttttttttttttccagtgaatatcttctgcttgaggtccaatactgtatcacactcacctcagaattcctcgcacctggtactaggaggagttagtatatgcttgttgaataaattttgtaagaattacagaaatggatgattagggagagtggaaattaaaaagtgagatctggcttcagtttcagaagggtcaagctggttcagctaaggggtgctatgtgttggcagggtggaattactaccaatttatcagtatagaaacttgaccttcagccaagctcaatgtcttgtttagggcaagttcatgggctttctcctaaaaatgcacaggcctcgtgaaattcaccccctcataagagagaaccaccagagggcctagggaggagatgaatcttttttccttttttcaagtgccaccataccttacaaataaagatcacctatgacctcatttatggaacatgcgagttaatttagtttttttttttaaagagacattaaacttactggtttgaaaaatttttggacattcatctgtattcaataaatacaatatactaagatgctctttgcttcaatgtggttagatagaagtgagaaaggagagcaggaattgaggaaggaaaggagagaaggaaatagaaatagaaaagaaatagaaaaaggagacaacgttgcaaggaaacatccagaaggaggctcctgtgacatcctgcaggtcactggactatagaattcgaaggaagtaacctcttgttagcatgctgtgaaattttaatatttccctttttaaaactttaactctgttccagataggtcaccaagctcaccccttatcttgtcaaccttcactgggtatcctactatatacacaggattccatgtgaggctctagggagcaaaaatgcaggaaaccagggtctccccatcataagaatgaagcaatgagatgagaggggtaaaggcagctgggtgaaggtgtgtgggtgcagaggtactttcaggattagacaccagttgggctgagtccaggcaagaaggctttggtggggtaagagcattccgtgcagggctaacagcaagagcaagggtgcagagggcctacagaggctccaggttcaggaatcttggtccctttccctataatccccagggtccctttctccataagctcctcccagggtatgttgctggaagacagggcagttcttttttggtcctgggaaattttgccagatatcccttccccacaccccctaacctcagcagctgattgcacacgaggactgacagtcctgctccagtgaggctcactggcccaggcttctccatccctaggccccaggatggggcgatggggtgaggttggtgtcctagaccttaagcattgcccttagtagaacataagcctctgaggtcttcaaggctgggcatctcccatcatgcttaggctggatcttgagctcccctcaagtagcaccccatcttcccagacccaaggatcccaaagcaggaggtcaggatcccacctttcggaggttcaatgtccacactagcagatggggaaaggacatctcctctttctcttagggcttccatttctgacagcagccgccaggcacagccttcatgttgtctggcagatgtttatttttcagcttagggggacccctgggttgcaatctctgtgttccacagtgggtcccagccaggcctggcccatccacgttccccagtggcaaccctgactggggaggggggcgcgaatcacctcgaaacaccagtgcgacagcccagctccctgcgcgcacagatggtgaagctcccggtccctcccccagagcgggaggtgggtgtcctggccccacgcccacaccttgggcacttgtgcctgtgccccctgcccacccctggtggcggaactggccgagcgggcgcaagggagcgctgcagagaggtgggccggagcgcctgctcccggggctggagaacgcatccggaggctgggcagggcttcctctgggagcaggcggctgctgaataatgaattccgactgggagcccgcactcccgggctgcaggcggggcgcccagcacgcgcgcacacaccccagatacacgcggggctgacgcctggggccgccgctggccggccctgaggctctggaaccgctgcaaggagggctcgcgggctccgggtgccgggtctgtgggccgcttggagggggcgccggaggaggcggcggcgcggagaggggaggcgggagagcgggagcccagccccgccgcgctccccccttcccggccgctcccgcccggcctgtccgggctccccacaccggcatggctctgcttgtccacctcaagacggtctcggagctgcggggcaggggcgacaggatcgccaaagtgactttccgaggtagggaaccccctgtcgtagggggaccccagctctgggctggcggggataaggcagggcagggaggatggatgggaaaagttctggcagggtgggggccacgcggcttttcgtgagcagccatctgcccctggcctgacaggtggttgtgagttcctgaaaatcggggtcccccgtgttgctgtgtctgcgtctgtgtctgtccctccctgcacttgccaatgcgccatgtgcctagtggcgtgcagagtcctctgcctgcaggggggcctggggaggtagaagtaaggaccccacctctgaggtcgggggtcccagggctaagaggcctccactccctctccctccagatttccttggacacagggtgggggtgggctctgcagactggaagccccagtatggctcctagaaaccaggcagccagtagctctctggttgaggatactattggcttcttgcagatctgttggtgggcagggaccctttgggctccactggcctcccctctgtcaactctcttcctatcgtcctccccactcatgcatccagcagccacatactatgatctctgaccaaggctgggggctgagcatgacccaggctctgtctttgaggagcccacatccagggggacagaaggaccagtggggaggcatgcaggacaggtgcatgatatgatgaggatggggacgaggcagcacacgagccacagaagcagcacctgacccaggctggggcaggatggtcaaggaaggcttcctggaggaggtagcacctcagctgaaacccaagggactagcaggagagagcaaggtgaggaggtgagggcagagctggtgcaagggacaggatgctcaaggctgggagaggagttgggacatggaacaaggaatagacagatgatccatgaggctggagtccagagtgagtacgaaggcgaggcaggagagacaggcataccagggaagaaaggctgccttcatcctgaggacggtgggcaggccctgagggttttaagcagaaaaaagtaaggccaggtttacctgtgctgattgcccacccagctctgcctctgctggccacacagcccagctctctgagccaggggcatctctggtggcctttaagcaaagtccaggcactcctcactagacatggccttcccagagacaggatgaggatggggggatggggaggagctgagaggaccccgccagattaaagagcgaagtgaacattgggcccaggctgcatgcacatccacacctgggttcggagggagaggggagaccagggacagcagccctggtgcccacatcgcccctcagctggactggctctggctggaggctcaggttgtccatactgtggcctgttgtgcatagaattggcaggggtgcgggggatcgcagtgtccctgctggcaggtgggggaggaaagggtgggcaggctgcctgttgcttcccacactagcccaaggatggctttgtctgcagcaccctggatctctgtgtgccacctgctggctttagaaaaagcaagtatgtcctttcatctgtgaaacgtgtccccaaattccagatagcacagtacttggccgtttagctagattactatgataggacagttcccggctgcacaaaaccagtcacatttgcaggcagagaaaccaaggccccgttgtaaagagatccacaaagcagtagtggcggggctgaggcacaaaacctcccctctcccccagccctggctgctcaatcctgcaagccctttatctcttcctggtcagctgggagtgagcaccctatctgatgcccacctttttctttgagcactggggccagccctccagcctcaactgaacacacaagaatttgcctctttgcaacctgagccccctagactgagtggagagatccacttccaaagctctatacctgcagctggtggccccagacagagctctggggaaggagttggaccttaggaataggcctattgcaagcagatttccagaaagagtcctttgtaacaaccagagatgcctcaaccattcatctgctgagccagcagttgacaaccagagatactccaaaagaccaacattaacaacaattcagaggaacccacccattccagaatgttccacagcagttcctcacatccacaaccactgttgaccaagaaaacagctgcagggggggaaatgggaaactggtgaagagtgagagggaggtgctggccgagagttcccctaatccctcgagtaaagttcatgacagtttgggtgagggagccctagtgagttgtgcctattggcagtggcccatgcagaccagactagctggttgaaataagcttgaccttatgtgctgtgccatccaggacacttagagaagagccctataggtctgtggtggaaaagctctagataaggagtcagaaaccctgggtcctacctgggtcccgccactcacttcacctggatagtcctcatctttaaaatgggcatgtggataacatccacttcaacgggttacttcagtgaaataataggcattggagtttgaggaaagagcattcagatgactgatgtatctgggaggcacccattccacttctccctggggaagctgctggctcctgaaccatcttctctctagccagacttcctaaggggagaggagagcatgtctgggggcttcctgacctgtgtcaagagcaagcaatttgagcctgtcctctgctctggagggaccccctggctaagatgttcctcaggacccaagcctgaagcagaccatccctgagacccctgtccccattggggttagacacctaccagctgtgtccctggtcacccctctcttcctgccatggggtcagctggccgccccaccctcaggcttgcaccatgctcaccacccagctccatctccagctcttagctcttactaactagcacccttaacctcatcctaccctaattcattcactccctgaatgtgctgatatttgtggacaggcctaggaccctaggggtgaagacacagcccggcctgcaggagttatagtccattgagtcagacgggagacaccggaaggcctggccccccaagtcctagtcatgcacacagaccccagagtcccagagcctcggcttcccacgggcaagatgagactgtggtccccatttaactgagactcctacagtcagaaactggagtgggctgtctggaaaggagccatctcaatgacaggtcactactcaaagagaagcagtattcccctagcacttgtccttcttcaacctgctaaaatagttctcagcatcatgagaaccagggtgggagagcctgtaagttcctctagcccaacctctatctggtactcagcccactggaacctggggagaacctggacggtcagggaagtagccacaggctgtctggggccagccccgtgatcttcccatactccccaaccctgagctttcctgccaagataccgggctgcaggattgggatgtgagaggtgggcgatgtctggaggatgggtctgatctctgagtaactcacctggcctggtgattgaaccggagataaagacctgctttttcaaggcttctcccttggcctagagacttctccttcctcctttccccagcccactccatggcattcccataacactgaatttccagccattccccagatacaagccctatatatctccagaccctaaggcatttatttcttttgcctggaacaatccccaccctctaacttgagaactaccatcaattctgtgcatgtttcaaggcccagctcctcatgtcacctcctctgtgaagccttccccctcccttgcagtaccatgtgcacactcctgccacagctcagctcggcacttggtattttagaaactgccccagttctgtatgttgcactcatgtctgagcaccttcaaaacaggggtcccactttagctctcctcaccgagcctcatgctgagtcccaggccctgtcatcaaaatgaatatgacacaggtattgaggtatttactcattagtgggttttaaatcttccactgtggcactgccattcttgggctcagcgtccccaaatgtgagcctcctaaccccaccccagttctttatctgaggggatctgggactggaagaggcctcagaaatgacgacaagaaccctccatcgacctcctggcccagagggtcttctggggccccagagggaggctgacctcaccttttagcaaacgctagggagtccagctccagcccacaggtcagaagtaagaggggccatatgtggcccaagcccttcatggaacatgctctttctgagcacagctgctgtgtacaacacatgatacagagtgtggtttaataggcaaaccagggtctcataatgagataggggagcagagatgtgtgcagacataacgcggaaatgtcatccaactcaggagggcccaggtgtacctacgggtgaggcataaactgtttaggtttaagcctgtttaggggatggcagcttacttcttgcacatgtggagatgctgggggggggggggttgttttgggaagtgaagcaattggcaagggggcgggggacccgaagccaaaagaaagaagccacaggtttgggtggaacaaaagctgctggggagtgggcagggaaagaaatgaaccaggatccatggggccaggggaaaaactgtatgctgggaggggatgaagcccccacctgggcacaggggacaaaatgctcccactcgtggctgtggggaccactcaaattccaaattaaatttcttttccccattaaaatggaggaactctccctcttgataaataagacttctatctggaaacttctctgccatctctggtgaaagaggcagaataccccaatgcccccagtcttgcgatgctcccaggatgcctgggcctgtacgtgcactctggcccagcccacacctcctctcggaggggacatgggttaggtgttgctccctgcgagggggtgggcattgcccccacggaaggggacaaatggaggggacccgtaggccagcctctgcaatgcacactggctgtggactcagctctgtgctttccctgtgcctcccacatcctcccctgtacccagcactcacaggtccctccccagctgggggcgggggtgggcacagatcttctctaaaatcccaggtggcaaatgtacccctctcccgcccagaacaacccaacacaggccttggggaacatgcagagcacgctgaaagttccccaggcctctcctgctttgatgagtgtgttttcatgttatggaaatgaccataaaattatcttctgctacaaaggccctcagcaaaaatgctgctggaaatgtgctcaagcatagacttgcaaatgatttccctaaattgcaatgccttccttggttatcttacccacctttactcataacagaaaagctacagccctcccacctacgcccatggctgggtctgatctcttttttgttattaactttttataatggaaagtctcaaatacatacaagggttgggaaaataagttgtgccttggctaccaagctttcctcatgcattcttaacaacaatcaactcctggccagtcctgtcccatttgctcctctcctactcccatacaccaaattatttggaaacaaagcccaaaaagccataccatttcatctgaaaatattcagtacatagctataaaagacaaagactccatttttttgaacccacatattacatcactcctaaaaaaataattccttaatattatcaaatattcagtcaatgatcaaatttctaattgtctcatcgtcttaagttttttccagttcattaaaagcttcattttcatgtgcttcgtaaattaagtattttgtcattcattcactgattcttttttttttttaagattttatttatttatgatagacatagagagagagagagaggcagcgacacaggcaaagggagaggcaggttccatgctgggatcccgacgtgggactcaatcccggggctccaggattgcgccctgggccaaaggcaggcgctaaaccactgagccacccagggatcccatcattcactcattctttcattcatccagataataatattcagtgagggctagctatgtgccacgtgtgattttaggcattggggtaacaaacaataaattaaaaagacatggtccctgccctcaaggggaagacagtcattgcacaagtcatcatgagcagcatgatgagtattttgaaaagggaggtgcagatgcaaggcagcatgaggccaaggaagcccactcagccggggaggaggggggtctggaagctgccctgagagggcgagcaggattcattaagaaaagatggcagaagagcaaatggaaagggagatgggagcaaaccagcggtactggtgcctcccaaagtcagctgccttggagccaacaagatgaagctggaatgtacacagggcccagggaagagattttattgagggggtacagaggatgggctgatacttaagctggaacaaaacctacaaaaggccccattccaggcagaagggttaatatcagtacagatgtgatggtgtggagtcacatcaagggtttagggaactgggagtgcttactgggagaagggtgggaatggcatggaggggaggttgggaccaaacacagaggctttgaacttcattttgttactgaataggagtcaatgatgcttttagaaggagaataggacagggtcacctggttttggaaaggacattctagatatcaggaccccaggccagaagcccagggaggaagctggggcagtggtacaggtagagaaggctgtgccttaatggagaggctgtgggttaggagagaaggaatgacattggttcagggaggagttagtgagctctggagtgggtagggagcaagagggcaggatttcttacttgggtaccaggaatggtggtgaggccactgacagagaaggggagcatgcaaggacaggcttgcctgtcagtcattctagtgaaaatgttctacaggatgccagagatctggcttggtacagtgagtgcccaggaaggtgctggcacccagtgatttgagaatccagggggtaagagaaggtctaggagagggtgagatatgtctgagtcctcatagggctggtttagggtcaagtgaaaagggtgattacatgaaaggctttgcaaactgtaaagtactatgtaaatataaggattatgctctttatcccagggctgatcccgctgcagacttccagagagacaggagtagagcaggttatgactctcagggactccacgattcagggatttggggagtgggcagagacttacttgacattccttgggattcctgttgacatctcaaatacagccatgagatgacggggtgaaaacaccgaagtcacaaagatgggctcccccaggacaagcagcagggccaacacggtgtctggcacagagcagccctggagtagaggcgatcactgaaggagcggggcccacaggtatagcgggaacagttgcagttagtagcaggggccatcctggcagcatcaggcagcagttgctccttgcattgatggttccagaagtatctcctcggacagaaaatatcatgtgatcatttttaccttcaccccttgtgtacttcctgcctggactgatccaccctcaagatagtggctcaacagtcttttctttctactttattttttttctcaaagcagaagggctcattggcttagttgaaagttagtttccgctcactggcttttttccccctcaagccaagacttaagatacaatcgggatgatagtttgtttttttttaagattttatttattcattaatgagagaggggggaggggcagagacgcaggcgaggaagaagcagggtccatgcagggagcccgacgtgggactcgatcctggatctccagaatcaggctctgggctgaaggtggtgctaaaccgctgagccacccgggctgcccccgggatgatagtgttaacaatatttttaccccatttaagaatgtaaaaagtcactttcccaccatgccttattatacgtccagtggctggcatagagcaggtattttgtggatcaccagaaccacaagttcctctaatctggcacagtaatgggggagcctaagacctgccagtagctgagtgtggctggcactgtcctaggcttgagaggaaataccaaactctctctgcttcaatgcctggtctgaaaaataggaacaggggccatcagttagttccatggcaaagtaagagtttgagtgagcacctagaagaaagtggaggtgtaagctgaggcaagagatgtggtttataatccctgccttgtcccctgcctctctggcataagtctgagtttctactgtgtatacctgggtgttcacaggataggcaaaggagagataaatgaatgaaggtcgaaattatatttgaatgatatttgtggaaaatagaaggtttgaagtagatggagcaataggggaaagagaaaggtcagccttcccctctgagtggcccagggactctgcataacccaaatctagctctctgagtcgctggtgattttcagagagcacattatttaaggaacatctttgggagaaagtgttattacaggagataattacaaacaactagacacaagaatcattaggaatatagaacatttgacaacaccatcaaccgccttgacttaattgacatttctaggacatttcaccccaaactgaaagataaacattcttctcaaatgcacatggaatattcatcaaggtagaccatacactgggtgattaaagaagtctcaatatacttcaaatgactgacatcctgcaaaggatgttctctgactgctctagaattctctttgaaagtaataacattaagagatctttaaaagctccaaatatttggaaattaaacaatacttcttaaataacctatggtcgaagaattaaacaaaagataatttataaaacattcctgctgaatgataatgaaaatacatgtcagcatgtatagttttaaatgtctaccgcagaaaagaaaaaaagtctaaaatcagtgatctaggtttctgtcttaagaagctactaaaagaagattaattaagcctaaatcttaaaagcatcatgctaattgaaataagccagacataaaaaggccacgtatcatatggatccatttacatgacatgcctcaaatagacaaaccatagagatagaaagtagactagttgttgcctgggactgaggcaatggggaatgaccgctagtgagtgtgggcttccttttgggatgatacaatattctggaattagatagtggtaaaggttgaacaactttttaaatgtaccaaaatcactgaattgaagactttaagtgagtaaattatatggtttgcaaattacatttcaataaagaaaatgtaagtaaatacaaccaaaaaatattagaaccaagagaataaaaaaggaaatgagaaagccaacaaaactgaaaggtgattctttgaaaaaaattaataatataggtaaactgtagcaagaatgaccaagaaaaaaagcaagaaaatgcaaattaccaatatcagaatgaaaaaggagatatcatttcatcaaaaagaaaataaaataccatgaaactgtatctcagtaaggttccacaactcagatgaaatggacaagtcccttgaaaaacactttactaaactgacacaaaaagaaattgaaaatgataagagtccaagatctaataaagaaatgaaattagatataaaaatgatgttgataatgataatgatgaaactcttttcatcaataaaactttagacctctattgcttcacgggtgaattctagaaaatgtttaagaaagaaataatactaattttacacaaactttcagaaaatagaaaagaaggaacactccataactcgttttacaataccaaaccctgataaagatcttatacaaaaagaatactagagcctaatatccctcatgaaaaaagacgtaaaaatcctcaataaaatattagtcaattgagttgcaatccatgacagggataacgcaccataacaagtgaattttatcccaggaatgcaaggttagtttaaaattagaaaactaatcaaagaatttcaccatattaacacaatataagagaaaaaaacctctgacaggtaagaaatgcttttgacaaaatccaatacctattcctgagaagaatgctcagccaacagggaagagaggggatcttcctcaatctgataaagggcaagtacaaaaaacatctggctaatatcatacttaatcttgaaacaaaaaatatttatacacagaatattactcaacaataaaaataaatgaattacagttatattcaacatggataatataatataaatattatattgaacaaaagaagccagaaacaaagaagtacattctatataacaccacttatataaagtttaaaacaggcaaaactaacctttggtaatagaaatcagcagtgattacttatagggggtagaggctgaatggaaagaggggggcaagagaccatcttgagaaaacggagatgttctaaatcccgattatatgatgattacataggtatattcagttattgaaacacatttagttatgtgcttaagatctgtgaatgtaaattttaccttgttaaaaataaagagctgataacacctaaaatacctaaaacttgaagaatatgtagatgaggaagaaaatagtttctgattatatactactaaaaataagctaacaaaatgggattcacagtagagaagatcatttttatatttaagatgtaacttaaatgtcaaaagcaaaaacagtactctttaatggaataatggccattttttttattgggtgatgaactatgtcccaggtgtacaagcactaccatttgcttcattttatggatgaggaaactaacaaagagaggttaacttctctaaggacacatggctagcaaggggttgagctggggtttgaactcagtctggtccaagagcctatcactctcctgtgacctcctgtgcctgtaagggacttgacacttcactcagtgtcagtttccagttccaggatataggtttgtccaggacaattgcctccagtttacagatgatggctctgagactctctggggtagcatagctagctccaggcatgagtacagggcgtgatgttcctgaggcttgttgtcaggacattctccttcacctttagatggctctccacccccaccttgtgttctctcaggaacccaggactccaggacccccctcccagatcttccttcagtggactgctccctaagggctgacctttttcattttccccttgaccatcagaattctcctgtcctgtatcctgctctttcaaggctccattctctgttcacacaaacatttgctcacactgtgagcctctaatggatgtccttctctctcccatctccccagggtcaatgcccctgcctctaccatgtcttccttgatctgctaagatgaggtcatttctccttttcttaagtgctcacgttatcacactttgttgcatgccaatgatccaattttgcctttgtgtaggagcttttacatgtctgacctatctatccatctcccttctggattgtaataagcttcttccatcagtgtcccaatacaaaatatttttctataacccccatcccctcctccagagccaaatggccacgctgacacagcaggagcagaagacccccttgcatgtgggagggaacgcatgcacaccagctaacaacccaggccctacatacctgccttttctcaaggtctggttctaacaaggtcaactgtctggaagagggagctgtttggtgcagacatcacatgttgtacccttaagtcatgtcacatgaaaggctagtgctccatcctgcaaacgagacaagaattgagctggccttcttctagaagggtaactataggagggatatggtaaatggtaaatgacataccagatacttctaggtagctttggactcttgagtccctccatctggtgtgtccaatgtcatggcacttcttacgcttatgagctgggtcgactctccaaacttcatttattgactcaaggaatttattccaaacctaacagctctgctgtcccaccagcagctgcctctgaaggaagggggtgccattcacttttcctcatctgatctcctgctcactctgtccacaaagcctccccgatgcaaggaatgggctatttttctttctttcggacctcattctcaatcttctccgcagcaagaaaggtgattggatactgggattttaaatggttttgtctgaaagccattaataatggaactgaaatgtcaacacgactggtgttaagtggagaagatggcaagtggaaatgaacttgaaaggaaagacaggggtaggaatacccattgataacttggaagggattacagaagtcccctggctctgtcctaatgaatacaaaggaccaccagaatgatccctgccactgtttgcacaaactcacctaaaaaccagcttttcaaaaatgcttaaggacattctgtttctgtacaactgatttgatttggtttagcaaattttttttttcctaagcatctagaggtaaaattgagctcatcctgtttgacaatattcaccacatttaaatccccagagcctgaggcaatgaggttttactgcatttcggaacagagccctggtgtataaattctgcagtggctaatttcactgtattctatgttctctgtaacaaggctgtaagaaataaataagcagagatgggtttgaggctctgaggcttcgtgcgctatgctggagtccctccctgcctccgcccaggctgccctgcttggttttcactccaggaaacccttgaacacagcatatccaggctcattgcgatctttgaggattaagaggtctttgattattcagagcggcaggtccttggggaagacccagcgcacacataagctcacctggtccccagtttatattgtgtgttacctgtggggaaaatcagaagaaactcgggcactatctctcatgcttccctatcctcccctggctgccctggagttggttggtgagatttttctatcatgcttttttgttttgttttgtccctggctagtgctaaagggtctttgtttcccatctgtctccttcacatctgttttatgtgtatatatcttctgcttcatagcttcttcctcattatctgagatgcaaccccttcccaacacgcccatcctccacacacacatacatacacgcacacggatctctacttacctctgacttcgaacccctggcctcctccttgtcagggggtagctacatgcttgctcctgagttctagagacaggcaggccctggagatctctgtaccagccctcttattatgctaacgagagaaccaaggccagggggtggaagtggctccaagagcatagagccccatggcagtgcagggtcagagggggctcactccagccttccctggcctggcactggctggccatgctggggcagtgtgcactcccctcccttgccctctctgccaaagtcctctcctgggtccctatcttgtccatcagtgacaaaccaaactaagcctcagaatggagctaaactccgccttgagatggtccttcaatgacatggaccattgctttaagtcagtggggatttcaaagcatttttctctcaatgacagaagtacagcatggtcacggaaaaaacttcaaacttcagcatatacagtagaaggtcaaagtatcctgctttcaatctcttcttactctccctagccagaagtaaccatttctaatggcttgagatcattgtctattcacagatacaagaatttggtttgggtgttgggggcggggggagttgtatacaggatcctgttatccatgcagcttttttttcccctttggtatacaactgacagatgccaatgaattaatcctaaataataatttcttcttaatgccacctacctctggggttctcctcataggaattacaagtccttcccacatgcttccaccccccacacaccaaaaagacaaaacatcccctttgaaacaatatttatctttctttctctgtaccacttctctgtctcacataacactgtatcttgggatatggattatatagtattgatccgacaacctgttccagatcctactagaccatcagctccttgtgggcaaggatactgtgcactttatccatacctttatcctgagtctccaggaggtagcctggtaccttgtagactccagtgaatgtttccctaagtaaattaaactggcctgggtgtcccacacactgcccaccccatgtccacaccccccccccaacctggttcttccagcaacctggttcccccaggatgggatggaagagcagacagcttggcttctgccctggtaggtggtgtatggatgtgggatggtgggggctgggaaaacctgtccgtatcacattcaatagtacccacgccagtgttaaaaggagggggtggcttgtgggagaagccacttcaggctttcctctcaaaggttgccagaaaaatgaataagagagtaggagtagtaaagtcccttggcttccaggggaggagcgtctggggtttgcctggttgtcccagggcctggcttgggcaggagctcctgggcctggctgcagacacaggcacaaagggggtgctgccgcctggcagggcgcccgctgccctcggaccaggcttctgctccaggcagctgcaggccagggaaagccagcagagccgaagagacagcaaacgaggccaggaaagccaccgggagagcagcaaggtggataaaagagtccagggctcccctctcacgcctatacctctgaccagcctgtccctttttatgtcaatgtcccatttgtaaagtggagctagcggcctttgacctgcatgtgttgcagggctcccaagggggtcagatgagacaatatgggaacttgcctcatcttgggggagcactgcacacgacatggggcccccagttgataacaagtgctatgtggatccaaatgctgtggtggcgagtgccaggtggaggtctgaccccaggcttcttgtcctttttccccacccagggcaagccttctactcccgagtgctggagaactgcgaggatgtggcggacttcgacgaggtaggatgccctgcggggagctcaagccccagccataggggtgcgctggccccaaatgcctccccacctctccctttgcccaggagagctgggtgcagagtgacccaggcccagcccacagcctgctgccctcgggggggatttttgttctccagagaaagggcccgcaggtgttataggcttaaaagtgagcccccgggtgcgcctgggtgactcagtcggttaagtttctgccttaagttcaggtcatgatcccagggcttatgggatcaaaccccacatcacgctccctgctcagcacggcgtttgcttcttcctcttctgctcccactcctgctccccctgcttgtgtgcaaaattaattaattaatcaattattatcttttaaaaagataaaataaaatagtagcaagcccccagccgaggtgagggcccagcagcacagaagaggggcttccctccccacttccctgggcacacggagggctcaggctaaccctacctgggcttccgacaaagccagtctcgtatggatggcactcttgtgtctctaagagctattgaggtacttttcccactgcatctcccaaaaaagctatttttcttttgaaccttgggctcagagggttgagtgcccctgtttatggcacattatctcattgttcctactaccctgctcttgttctgatgcatgttttgtgtgtcatgtatgtgtcattctcctttatccacattccttcctttctctacaaccactctgatgtgtttaatgtggaacctctggtttcctgtatgtcctcacaaaatttgtgtggctatcttgtgaagatataactcatgttttagttaaatggcattgtgttacatattttacttcaccgagcaagatttttcagttccatccacgttgctacgctaatctgctgcttctccctgccatacagaactctgtgggcacatccaacacacatgagggtgtttggccaccctggtttgtctgggaccaagggggatcctggcacacagactgtaagggataaaatgggaaaaatcctggtcaaattgggataaattggtcatcctgcggatcctttacctaataattcctccagagaggaacctccaacttgcctctgaaaccacatgcaaggtaatcagaaggcaatgaatattcttatgcatgtcctctttggacttctgtgaacatttctctagagtacacaccaggatctgaaattgctagctcacaggatatgcttactcagcacggccatggtctacacttctaccagcaatgcgtgaggacccctgattcccaatcctcatctacatctagtggtattcagctctctgatcttcaccagtctaacagtgtgcctcgttttttaagataatatatttaaagtttcctttttcgtaaattgcctgttcatattcttttcccttttcccctgttggtatagctagttgtctttatcttattgatttgcagtagctctttattcatccaagatatcaaccccttgttggatttcgagattgaaatttctcttagtccgccatctattagctttgtcccctcactgattagaagtccttaatcccggtgtgttttcaagttttgctgaagatatatttacactcttctagagtacagatatgttgccctacattttctgattatataattgtattttttttaccttgcatgtggttttagagggggcacagttttatttttctccatataagaaacaacttttcctaacatcaatttgataagcaatcaatcatctctctatttaggatctatgtcttagccttctattctatccctttaatctgtttgttcttgaactttatcacactgtactcattaatatgacatttttgtatgtattagtatctgatgaagcaagttccctctgtttactcttctttttaaagggtgaactgtttgtggacctttattcttccagataatttttaaataagtttatcaaatccttccaaaaaccaaccggaattttgattaagttccattggatttaaaaatcaattgaggaagatgtcaattttttataatattaaatcatctactcaaactatccacctccctttactggcatttttaagtttactgcatagaagtcgtatgatcttcattattttctcttattatttttaaaagatttatttatttatttgagagagagaaaaagagagagagagcacccaaacagcttgggggacagagagaggatatgcaaacagactcccactgagcaaggagtccattgcagtgctcgatctcacaacccatgaaatcagaacctgagccaaaaccgagtcagatgcttaaccaactgagctactcaggcaccccaatcttgattatttccgagactctttctggttttattgttatcatgaatggtgtcttgattttgctacattttttgactattgctgacttagagaaatgcttttttttcctttagaagtcctcttttatctggcaaacttgctgaggtctctgacttgtttttatatttatggtttgttctgttttgtatataggtgatcatgtcatctacaaaaagaggttttatctcttcccttcagtcctatccccttatttctttgtttttccatggagcattgaccatgattcctagttctatgttacacagtaacggtgattggtaggcatcctttctatgtccccagtattaaaaagaataagtgcatctaaaattttgtcatcatatatacttgctctaataggatcttactatttgtctaactagtttgctaagagttttcattataaaacattgttgaactttattacaagtttcttctgcatctattgagacaatcataactttgctcttctagtatgttccataaagtatttcatttaataaactgttagattcaactagcaaatatttttatgcagcatttttgcagctacatttgtaaagttttcatcatttgataatgcataaaattttctggaacaccatgcataaaatagagatttgctcttccttgacattttggaagaaccacatgcaatggcatctaagtttggatggtttagggaaggggttcttcaacccccttttcaatttctttgtgtcttcttgcaccagttttggatttctatatttttctagacatttaaacatttcatctaggttttcaaatttattagcacctatttgattgtaaagtttttaaattgttttaaagtattttttgtgcctatactgatttccccttttgtattccacactgcacttatttttatcatccttctgtttttcttggtcttgctaatgatctgtttatcttattaatctttgtaaagaactagcttttggcttcgttaatctcttctgttgttcactatttcattatttctgcttttttcttaattatttcccttctccctgttttatttatttatttatttatttatttatttatttatttatttatttatttattttgctctgtggctcttttcctaacttcctgaattgaatgctaagcctgttatttttaacttttttatttcttgataaatgtatttaaagatataaattttgctcgatattagccacatcctacaaaattttatatgtagtattttcattatcttcagctttaaacattttttgtatttctttatgattttcttttaacatatgacatgttagagtctcattttgttcgtttctagttttcttgcattatgatcaaagagcacagtctgtatgatagtgatacttcagaatttattgggaccttgattagggcctctatgcatggtcataaatactccccctgcctaaaaggaatgtgttcagtgaagggttctctatagaaaacaatataacttcaagcttttataatataagttcaggcttcttagttgtactattcaattcttaaccttttttaagattttatttattaattcatgagagagagagagaaaggcagagacacaattcttcaccttttctgctcatttttctcttcttgatttcagtttcaaaaatgattgcaataaaatctacttctacaattgctgatttacatatttttccctgtagctgtcatttgttgcttgatgtgttttgaaactatattactaataagttttatatgttcatgatggctatatcttcttatctacttttctttttcctggtacttaatatccttctctgtctgatatgatgtttttttgcattgctttctattttgctagatgttgagattatgatctcagctaattttggttcatttgcctggtctatctctttcagttttttaattttcttggtatatcttttttcatgcctccattttcagtatttctgtgctattaaattcaagtgtgtctttttagggcatatatttgtagattaaattttctttcccactaggagactgcgttttgattagtttcatccatttacatctattctaattgctattttgatttttatttctaccaccatcttattttatattttccatttgctgtcctttttgtttgtttgttttcttttcccctttccagctttccatggaatagatcgggtttccttttgttaagtgaaaagttatacattctatgttttcaaggtagtcacccttccttggtccctgttgatagctggaaaataaatcagtaattataattcccccatcgtggcaagtattataatactctctctcctaagcctctttgatttccctacctcagcccacactgtctagattatacaattttcattccaggttcttatgaatgtgtgttctccttttctttttatttgccctagccttctttatcttttttgaggacaacaaaagtcttcaccaagatatctaatcaccttttcttctcctatctcctgaagcatctcttggcactgtttttctttttatttgagtactttctctaaaagccatttcaatttgggtctttgcatagccaaccctctaaatctttgtaaatctgagaatagtttcttatttcttcaaatttgaacaggactttctagatataaaattcgaagctcaaaattctttcctttacttcagaatagcagtgcctgttgctgttgagaagtctgaaggccatctgtttcttgtaccttcaagtgggatcttttctttttccctgggggagaaaaaaagtgtaattcttttatcttgatattctcaaattttattataatgtatctgactgtggggttccttattgctcccgttttgcactactttgtgagctcttttcaaagccaaggcttttcatctttcatttattatagcaaattctacctccattttttcccaaaggttccttccattcagtttttatattgttcacttctctccgactcctgttatcagatgccgctacttgcacctctaactgccatttctttgcttttatatttttataaaagggcctatcagtcctttcctgcttttttctgagttcttcaaaatgatcttccgattgactaatttgttctttctttcttagtatcccttgtttttgttttatattgctaatatacgtctttatggtccatttgttctaatgatcctgcccttgtggtatatactgctcaggatgttgtcttgcctgtagaagaaatgtctctccaagtgtttgtttacccagttcaagtgcccctgggatcagctaccctgtctgctgaccagtctggggaagcatcaaaaccagctgtgtcaggccctaggggttgaaagcaccagggggaccccagtcaccacagaaacaggcaaagtctcctatctaaccctttaaggagaaacatggtggccagcaagcaggctagatttttaacaaactagttttgaggtttcactgagaggaggtccatgaacacctatcttggctgctccccagcctccgccagggagcctccaacctccccaacacagatcagctcaaagaggctttggtctcttgtttctcacagttgtttgtctgtttgtgtgttacttactagaatctgtatttccctcttgcttctagagtttctccagggttgactttggggtaagaaccagcagtcctaagttaccatcgtggcatgaaacagaagctctgctgtgacccccagaatagcttactccttccttcttgggctttgcttctcacctttggctcagctggctggaagggcctcatggaagactatttgtgccctttgaagctggtatttagctgagcagctaccaggctgaggggccacccagaacctctgtctcctcctcatgttgggcccatcccacacagtgttgctgtgtctatatgcccacagctgcaggcacagggaagcaaggccttggccttctctcctgcactcaaaagtaaccactgaccatcatcactgccagcaggctgtgccctccacaaggacagttctgttctagacatcttccacccctggctgtgtcactttcagtttgtttctaagcctctgttacccatgtgtcaagtgaacccaatgataggtatgatgaacaaaatgagggatgatggggatgatggaaccatggctccctactatgccagcatcttggccttgggcttaccccactacgcaacctatgcttccctcccttcccctttacatcagtcggtgcccgagaggaggggttggttgagtgaagacactggatcactccctcacagtcctgctttcctgggcctctgcctctgatcatccaggcagagcatctgactctctccttctcatcaagtctcccaggggacttgtccacccaggcctcagccaatgagcaacctgatgccccttccaagggcgctgccacacctttccattaactgcaccccgggacacctgagccacaggtatacatgacattcaaagttaatcaccgtgtccttcctcttcccaatgctgcccaacatggggcgagtggagaggcagtccctgccggccccaagaacaagcatggggccacattctgagtgcctcttgtctgccaggctaggataccccagagggggaagcaggctcaacagcgcatgaggatccatgtaggaacttgggcatggaggagcctctggttccatggttgggggggcggggctcagaagccagggagtagtaagcaaaagcacatggccaaagttggagagttgccccaagatggggagaagtggtcctcacctgggaaaagttctactgattcgtgagctgcctgggaagtttctggtggttgcagtggggaaccgactggcacttcctggaatgggggccaaggatgctaaatgacttgcaaagctcaggccctcccacactgtggggacttgcccctcacttccccgggggagccccatctgacaatcatggtggcagctttgagcagcagcattgcttcctgagcaatcctcttccatccaatctccacggcaacctacagatgatgaagctctggctcagagagcatgtatccttcccaagggccgtaagtagcaaagccagcattctaagtccatgcttcaattaggttataaacccattccagaggcagcagtaggaagctgctcctgggcctgacccccaccaccgttcaaggccgtgttggtcttccatgtgccctgccaccactcctccctctgaggagtagccagcagtctagcaacgactgaccagcagtgcacccccacaaagcaggggaggcagccctccaccccctgctcaaggagggcccaggggcctgggtctgctcagccctcaaagagggtctgaaactgcacctgtgcttacacctgcctccccagactggagtagacaaatcctaaatttcctcgctggtccctgaaagagacaatctacctgtggttccagaagaagcttggaaaaagcatatcattggcccctggcaaaatttctgaaggcccttttgcttttcagaaagtctcttttctcatgtttactgtgcccagggccctcaggaaccaactcaatgagatacaaagagcactggcctgagagtcctgagaactggtctacggtcctccctgagacattaacaaactccatgaccttgggctggccactcaacctctggacttcagattccccttttgtaaaatggggataaactccttgctctgcctgcctttcaggacagttgcgtggctgaaaaatgaaatagcagacaagatagcaaatgtctctcccttctctgctcagacaagggtgagagggaccgctgcaggctggcctgaggaacctgagtagggaggaggtggccttggaagaaagacaatgcttcagacaacaatgggtggaaacagaacctggatgtggtgtctcctttccctgagattggaacctgagcccctgcatttaacctacagctctagaggaggagggaggggggagggagggagagagagagagagagagagagagagagagagagaatggcattgtaccaggccagcagctagcagaggcccctaccctgggggaaggagagtagtccccacactgagcccaccctaagccagtttgatttggctccaagccaggagcaatgtggacaggactccagaggtgaggccacaagagcaacagtacttgtaggaataataagaagagcagctgctacgtagtgagcacctagtgtatggcaggatgggctgagaacgtcacacaagcattataactcactgggttagaatcattccaggtgataagtagccacaatcagggtttgaacccaagtctatttgattccagcacgtacggtcacttgcaaagtgaacctgccttcaaggggctcagtccagtggggagagggacccagtacagtcaaagatggaccacaggtcttctgagcccagaggagggagaagtcattagcctgggagtgaggaggccagaggctggcctcacctgcccacctcacttgtacctggaagtcatgggctctgagctccatggggctaggaatgcacctgtctggttcatcagtggcctggcccccagcacagggcacaggaaatattgccaagtgaaagaatgaaccaaagaatgaacctaacttgaatcttgggcctttaaattcccaagacaacccctttccattgcattctaaagctttgcaacacattccaatttcctctccagatctggaggactgtcccttgctgatttaggatatttccagacctagtcagtgaggaagctcgaataatccaggtcatcctccagctcctcagggaaacctttccgtgggtcctagatctctggggctgataggatacagaaccctgccacccgggtcagcacctgccaggtcagggccaaggctcgggctggcgaactaggtcactgctcctcattcccagggatcctgagacccctattctgaagggaggtcctcctttcctcctccagcccctaacagttgctgccttacttctgccaatgttcctatcatggtcgcaatttcgggtctcctgcagaaccaagaaacgcccctgcctcctgtactgtccacagtgccatgtacaaaacctggcacaaggaagcactcaataaacccagaaggtgttcagaaaacatttggccctgaatggggtttgctggttggtgacatcttgagtgacagtgtttggcttagctactatctgaatcccctagagtgtttggaggctggcagggtaaagaatcttaaatgctgcatggattcccttggcccagtctctaggccaccaatgttcagagcacctcagaaacagaaggcacaactttcagctgttgtggccacaggaagaaagtcagactggtaccttctcaggctggagagaggccctttgttcccagaaacctcctgtagtgtctgcagcagcatccccaagaatgccaggcttccagaactctggcttccagaactaacaatacaagaagaatcactacgataggccaccatgttggtcgtactctcaccctgggccaggttccgtgccggcgcattgccagcctcacaataaccccaagaagcagtactgtgaccctcacctccacttcacagaagagtaagctaaggtgtggagagatgaactgacccacccaagctcactcgccgccagcccaagcagccattttgaggctcatttgttgagtacctactgtgccaggtgtagggagacctctgtggacaagacaaaattggacctgcccactctgctcatgctctgaactactctgagagcaatagtcaaggtatctctggagttcttggggcaacagaaggagaaggagcaaagcatcggtgtgtggagagacaaggcccggggcatggagcccagctctgccactgatgtcaggcctccccaacacaagcctgactcttagagagactgcatgggggagtgtcacagttatctagagctgtggaacgtactaccccgttctccacattctagggtttcccatgattctgtggttggctgggctcagctgggtagttcttccacaaccagctggaatacctggcgtgtccctgtggccttgggttctccaggacctctctccacgtggtctcgccagcagggtagcttagacttctttacctgacaactgacttctgagaggccctgctcttatctcaactactaagctacattaccacataatagctgaattactttggacaaattcgttctgagcctcagttccatcatctgcaaagtggggattaaattgtataatatacgtagagtgtggagccaatgcctggcacacgatcagcactcaagaaatgaacattttggttgctgtcaatctaggattgtcagagccacagactatctctgagattcaacctcagctaatctccagcttcaggagaaggtgcagtgtggtgggtcaagatctgagctaagtatcaggagccttgagttccaatcctgcctccaccgccacccagctgtgtgtcctgcaacacctctcataccctccacatccccctgtgtgaaagaagcatgtctcggccatatgctgtgagcctgggttattagcaaagagagctctgagaagtacctaattctacccagatgtgctctgtgggttctgagggggagtgcacaggcccgggagctcctgagcccccaaacctcccctgtggtcttcctgtgctctctatacatcagtacacatctccccaactggtggaaaggaagtaacaacaaaaaggagcagacaatgagaagaaacaacattttttttttctcgtaaaagagaaacgggaaataagcagaccaaggcagagaggtggtcagaaagtgatggcaggagagggagaggcggtgcagggtcagggagatgagagggtcaactccaaacaggtagaaagtccccacagggaaaaaccaaataaaataagtcatgcctctaattttccttgaaaggacttctgctgatcctttgtgttcacttcatcgatgtaactgctcgacacccctccctgacggcaccacttccacagtgacctccttttcctcctagtctttctctccttccaaagtagagaccccacccacacactctcaggggggagcaaacacccacctgcttcatccccaggaaatgcaaagctcagaggctccacaagcctcttcccgcagcactatggctggtgagttgggccttcacgaaagagcttatttccctgcagctcaattaaaagcaacttcattaagaaaaccacacactcagccaagctggaggcatccagacagcaggagcagaagcgcactgaatgaggcctgcgggccagggcctccaaagtcctccccagacctggctcagaaccctctccctccatggccttcacccttcttggactgcttcctcctctctcacctgctcactccagctggcccctccctgggactgaggagagtgacataaggccattttcctgagacaggccctgtccgcaccctgtaatgtcttgccaagctggcctggtgccccccaaatgcccaggttcccaatctgggaaaagggcgctttgcaatggcttgcaaggccagctcccagagggccccaccctgggtctgctcggccaccacccacagagttctctgaatcatgttccttctagaggcctggcttctctgtgtatgaaacagaacacgggagcagccttttgagttatagtaaagactaaatgaattagtgaatctaaagcattcagacctttgcataacaaaaagtcctttataggggcgcctgggtggctcaatcagttgagcatctgcctttggctcaggtcatgatcccggtctgggatcgagccccacatagggttctctgctcagtgaggagtctgcttctccctgtccttctccttgtgttctcttgctctctctgtcaaataaataaaatctttagaaaaaaattctctataaatggcagttattagtaagattactatcgttactacttctttctagcctatcggcagtctggattcagtgggtatgaaaatgaaacaaatttaaaagtcactgctttccacctgttctgtcaaaatcccattgctcccatctcttagcggcattgtgagcagacctcagagctttctggtcatcttcagttactcatggtcctgtccagaaaggtttgctgtccaggctgttccagtctggcatcttctctgggcctgggcctgggcctggtcttctcgcttctgtccggcttgtggctccaaacatggatacctgctcaggccctccgcatcctcttcccgctccagcctggggtggtggacatggtctgattcgggggggggggggggggggcaccgcccactctctgtggtggggcagcttctctggcgagctccagccagctctggaagctgtcagcacggccgacctgcgaaccctgtctgtctgtctcatagagcaccatgtgggtgggttctgcggggaacctgagcggcccaccatgtagtagggatttccaactgaggacttgaccccaccccacctcaactccagccctgggtcacccaagctgaggacccctcccctggagggcaggcttgctgagcctggctgcccttcgtagcacccactcacttggccccacagagcagaaatcacacacttgacacacactgcactggcactgtcaggctccttatggccatggtgcctcacgggtctccctagaggtctgagggacagaccaatcagtctactccccggcagatgtgactggcaacttgcatgccaggcctcccttcctgccagtgccttaacctctctgagcaattctcctaggaaggggacacagaaatgcctgagatgtgactgttgccaccgttccctttcccagtcttcttcataccccagaaagaagaagggctgggatgggggtagcaggcctttgaagaagccctgaggcagctgcccggttctgcctattggcagctcttttcagaggatgggtacttagcacctctagcctctattttgggccctcattgccatttctaggacatcaggaaaaatcccactcaacttcctactcatcattattatcgatttaatcatgaagccaagatagaagtggggagggtaaatatagaaacagcatgttggagacaggctgcctctcctctgtggacctgaccctagtaacaccaaacagctaaaatctgtccccagagttaacattgccagggtgaggggtgatttgacctgaatgggggagcccaggacctcccgcttagactgaccaaaaagattctggccagagagagctggaagcttataactccactcagcacacagcaaaaactgagcctatgcccacaatccttgctgttaccctggagcccactccatcctggctgtgccacccactcctgagtgcaccccaggaattaagctgagagtcagaagtactggttaggcccaggttcttgcactcaccccatgaccttgggtaggtcactggacgtctctgagccccatctttgaaagaggcatgggtcacaatacccatgttacaaggtggtggttggaattaaatgagattttcagtgggaactttatccctgtggagcactgggccgaagtggagggccaccctaccagggatctgcctcctaagcctcagccccccaccccccgccatcatttccatctaaggccacagctgtctctctctccctagaccttccggtggccagtggccagcaacatcgacagcaatgagatactcgagattcagatcttcaactacagcaaagtctttagcaacaagtaagtgccgggtgggagaggtggggcctaaagggactggggccctgccttgctccttgggctgccctctcctttgggctttaaaggggactcacacccacagcctactctggattgactgtcaaagacccccttcctggctctctcatgttgtctctcagagtccctctaccctctcaaccattgtcagccaagaaccccataccctcccattcgctccttttgtccccagctccatctcagttttctgtctccttctttaagtcttctgctttacaccatccctgggtcacagtaacccagcagaggagttaacagaatggctgataatatacttcaatagatcatctaccgccttgagggcaaacttgccaaactgcggcagtttgatgcagtagtttgggaaccaggaaagcctgattgtagattcccagtgcagccatctactttgtgactcagagctggttacataacctctctgagttcaatctactcgtttgtatgaagtctaagcatatacctcgaaggaagctgtaagaattaaatgagatagatatccattcattcattcattcattcattccccatatgtttacgaagtgcctactgtgtgtcaggcactgaaccaggtgctgaggatagcaagtgcctaccctcatggagcttacattcttcaatgaagcacacctgccacatgagcactatcactactaaaggtttagtaaaagtagttcccatacatctgtctgggcaataagcagaactcagatttgagcaatctggaatagtggctaaatataataaatgtaaagtcctgtttggagattcagaaccaattgcttttataccagctagagggggtcatggatgaacagcaacatgtccagaaaagcatggggatattacttgctgagagtgcagtattactcattagtgggaggagactacaaacaaaagaaaatctgacctaatcctaggtcatattaatagaagtataactatcagaacaggggtaagggatgagggttccactggcctcatgctggttggaaaggataccagtaggcagcgccttggattgccaggggaagcgacttaaatctgatgaggggatgagagcctcaaggagaaaaccacagaggacatgtctatccttccatctatccatcacttccatccattcatccttccatccatccttccatccattcatccttccattcatccttctgtcctttcatccttccattcatctaaccatccatccacccatcatccatctatccactcttccagtcactcatcaaacattcactgagcaaatattctgtaccaggcagacactgtgctggaggtactgaagtgagagattaagtcaccacacctgtgccctaagaaggttttctgccatttggagcaggaaaagagatgtgtgcccagaggcaggaccaggaccaggttgcattgctgggagacaacagacagctgaaaggtagccagagctctcaagccagtgagctgctgggaagtagtgagctcctcatcactgggagaggccaagcagagagtagaccacaatgttgtggaggggatttttgaactggggtgggctgaaccacacaggcttcaaaggtttttattgggagcccataacatctcagctgagcatggggtgtgggcattttaggcctcctggcaggaccagaagggaagatgtttagggcagagaggcagcctcttggcttgttggggtatcacatcattcaggcagctgctatgacatccataagagaggttatgagatacctcaccaggcgtccccaagatgaagcaaaactttcttccctggggtgagagattgggtgatctgtgagtacaggagaaacaagaacaggagaagggcccagacacagaccaaagtgggggaggaaaaaaagaattggaagctgagggccaggagaggcatccaggcaccccagcagggacccacatgcaggtttcagagcttccgggagcctcagccagggtaacccttgtgcacagatgaggaaactgagtctcagggaagatactgagaacactggatggtagcagggctagtgctaggatgcctatcttccttctccctttctaatcctggacctcccagaaaaccagggtatgtgagcagtgattatggaaaccactgacacgaacaagattggtgtactgtttacaatgaaagccgctagacagtcacagaaatgctggaaacccttggaaacatcaaaactcctactataaacaaatcagaagtatttgttaaattgggaaattgaatatcatcccagtgaatacattgaaacttcaggcttcaattagttgttctgaaatgccaacaagagagagccagagcaggggagtccctaacctatttctccccttcttcctctttccccaccctcccttccccctacttaagaagcaagaaacccctccagggcaggtctgggcctgctgggaaagggtcctcttattttcttggaaaggatggaaaaatggagtgactatctcgaggacagcacaaggcccatccagacacaggccagcttgggggttggagtgggagacagggtgcttggagtcagatggggctcaggtctccccaccctggagttgccaggctccttctcattgcgcagctgagtggagggggagcctctgggatttacactgagcttaggagccaccagaaccacacctgcgcttgggacagtgcctggccactcgcaggtccccgcttactttgtggaatgagtgaaggaataaatgcccccatggggtcaggagggagagggtgtgcaggctggagcagtctggaagcagaaattcaaatggtccttcttctccgaaaagtttaggacactccaaggtgacagccaagtcacgtgactgatgcttttggggaaactgaggtaaaggaagctggtatgagaaacagaatttatggtctcatcaccacctatctcagagaaagagacttgtcctagaagcagaaggtggcttggaaactgggccctgacccagtggtggtaggggctgccaggaggatgagtcatggtgtgaaggaagagacaccaggagacgccaggtctgcccagcctgccttgaacaggtcctccttcaggaaccttgggcctcctgtgaggacaaggtgtcaggtccagaggatctggggtgtccccctttccagtccggaacggttgatgaagaatggcctgatggaagtgccagtttcctgggacttctgaataattcaggagccaggagagcagcggtggcctgaccaggccttgggcacttgacacgggctcccaggggaaagcaatgaattattgacaggccctggcgcctggttgccgctctattgtggtcattctctgggaccatccatgcctgaggcccccctccctgctgccccagctcagcccacctggccactctggggagggggggcagccagcctcccccgcggctgtgggctcttaggggatgccctctttgtgatgggcagtttcagtgggccacgtaagagaggctatcagaagacaaagtcaggtcccatctccttcacctaacttgggaaaactgaggcccagcaagggtcctggctcaggatcacacagcaggggcagggcagagctggccttcagctcagacctcccgacccccaggctccttcccagaggacaaagggcctcacacctccactttccagagaaaggcccctgctgtctgagggcttaggggcacaccctgcctggtcaccccaggccccaccctcccaggcagctcctccctgctgacccaccccaaggagaagaggcaacaggcagacctcactgggtgtgtagccagggtgggcagggaggtctccggggtcactacacaggcccgagctggggcttcctgcaccagctccctccctaaaggagggagggctgtggggggcatcttgtgggaagctgtattagcacacctgttctaaagctttgttttcacagcaagcacaccctggttttgcttagatggtacattttggatggacctgttaaaaaaaaaaaagctttataaaaatgcttttcttcatactttacataagactgagatcatctcaatcatccataaataaaataaaaacactggtttttattttcatttggaagaggttgggggaaactttcagaagtgaaagccccccagccaaattatcccctgggttccagggtcccagccccaccctctgggcctcagacagacccctggctctgtgaggctgcacatctgcccccggagcctaccctgcaaggaagaccttcagaccagcaccccgtgggccgatagcaccccctcccttcctgaagtcagtggagggaggacgggagggcctctgagcgcagcagtgtcagaggagtttcacttgagtgctctcactgcctcccagtaaagcaggtagtagcacctcctttgaggagacggaaaaaaggagggctcagagaggttggagagctagcctaagtcacacagctgtctacagggccaatccgcttctgcctgactccagggtccaggctctttctgctgtctacactgctcctgttaaggataatggcatccagtctgtgtgtggacaaggcttagaccagggcgtgaggagtggggagtttgccaggaggtgggccacatagcaagtgtggttaaagcagtgagaacagcggtggagtagcgagaggcccatcacagagcgcctagcaggggtggaggacacgctgggcaagccttcctctcaggccctccaagtctagggtctgagactgacctcagttagcacttgtgggggaatggctccatcctgccccctgggggtgtcttgtcacattgcagcgtctctgcagatccttcctctgctgtgctggggcagctcccaggaaagatgtgcctgagggtcggcactcagcaggtgctcagtgggtcctactagaactaaaggacccattggcaaagggcagcagcggacagggatcccagccggcatcatcagcgttacttggaaacttgtcagaaatacctattctccggcctcagactccgggcagcggctgggcccgtggtgacctggagctggctcttaccagctctaagggcagatggtgcacatctgccaactcggggttcagcaaccgttggaagcttgcactcggccgttggtgggagtactgacaccacagaaaccggcaggagccacgggtcaggactgttcttctccacggccagtgagttgtaaacagttcccggcacaaccatggatgggcaggtcccagtcgtccatgttttaacgagccctccggaagattctgtttatcctgaagtttgaaagccactgatttaaaaccaaaagaagtgaagctgccaaaagacctgtatttttcctaactatagtctgttgttagaatgtctacacagtgcagaggctgcaagcccactgcctccttgtgtcataaagacaaaaccaagactcaagggcagctgctccaggtcccatgaccccatcccagcatttctcctctgtgggcactgcccaagccagggagaggctgggacgcagccagaagggaggcctccgctgggctgggtcttagaagcacccagaagcagagtcgggctttccagtggaggaatggcgtggagcgttttgccctcgaggaggcagggcagctggtggatagggccctgagcttcagagggaagcatttcctatttgtcctctctggctgctcccaccacttcctcccctcacacagatgggaggccttttatttcccctcaagatttatttatttattagagagagaaagcatagtggggaggggcagagggagagagaaagagaatcccaagcagactccaatgcagggctggatcccacaactccgagatcacagcccaagccaaaaccacaagttagccactcaactgaccgtaccacccagacaccccaaaggagcatacttctagcaaaaccatttcacattctatgtacataaaaagccatttctcacctaccagatggtaataaattaaaatttatatttttactttttaggctaggtaacttataaaccacatttatttcttatagttcttttttactcttccttttttgttgtttgttttattcatttattttaatttttaaaaatatttatttatttattcatgatagacatagagagagagagagagagagagaggcagagacacaggctgagggagaagcaggctccatgccgggagcccgacatgggactcgatcccgggactccaggcagggccaaaggcaggggccaaactgctgaaccacccagggatcccccatttattttaatttaaattcaatttgccaacatataatagaacacacagtgctcatcccatcaggtaccctccttagtgcccattgcccagttatcccatccccctacccacctcctccccttccacaaccctttgtttgtttcccagagttaggagtggggggccttttttaaaaaaacagtgttcaccttctgtgttcctcaggaaggtatagacatcagtcatgtccattaaagtcagaattcaccggatgcctcatctcactaggatgtgtcccttcccattttctcgggctccccttcctcccctgtaaatcaagggcagtcccgggtgatgtctaggcgccccccgctctcacacactgtgggtgccccctcggtctctgcctcttcagctcaagacaatgcatacgttttaatctaccccatgtggaatcaccatgggagaacatctctctgagtgccctgttctcttccagagcaataaccttcaaaccgtagggtgaaatgaggttcgagtcaactcagtcagcatttattaggcacccactgttgttcattaactcagccagcagatactgagatgtcctgtgtgctggaaatatcaaatcgaggctggaagtaggaaaaatagccaccaccaccccggccccctcactctgctctggagaggctcacagtagagcgacacccctcaataccaaccagaccgctctggcagtgctgactgtgtgcgagatgctctgagggtctcagctctctaaacaatctggggaagtggggattattggctcattttaggagaatccagactgagagagcctgagttgtcagggaagcaggtaacttgctggtgtcagaggctgtgctcttcatagcactgtgctcccctcctctgctgtcaggtgggatatgtggggtttccacaaccagatgggcctttgccctcagtgggcttgcagaatgcaggtgtgggcatagcagacaaacaggggaccagtgagccagtggtgtcggtggtgggtagagccctcagttgtggttagacaggtggaagggacagaagctgttcatgtgtccaggagcttccagtccttctccaacaacctccacactaggcatctgggcaggagctcagctgaaccccaattccacatgcccaaggaccacaagcaggggggaccaagcccccatctggggacatcccccaaggctgttcactgcccacgaactctcccagggaaatgggtctcacaacatacaaccattcatgcttgttgggggtcacgttccctcctagacatgctgcccgagccctgaacaccagccctggctctggggccaccctctcctggagcctaagcaagccctccagccccccagcctactccccagccggtcacagcctcatgggatgtcagctccttactctggcctctttgtgtgaagctgccatgccccctctgccatccacaggctaatcgggaccttccgcatggtgctgcagaaggtggtggaggagaaccacgtggaggtgtccgacacgctgattgatgacaacaatgctatcatcaaggtgggtctgtcccagagagtccctggacttgccctttatggggtcccctggaggcctgcttcacctgcctcctctcacacataaggtgggctgggggatgctcctaatgggtggtgaggtgaggcaagaggagacccaggtcagatggctggagctcctcagcctgggggctgtggccagagcccttgatgatggtaggctctgctctcccggggtggggggacagcatctgaaggccagcctgagccctgccggccacaccaggcatgatcttcactctgcatgcctgtcctggagcctctctaagactaggcattcagcaagggcaagaaccttgttttctattcctgttgttacatcctatcctagcactttcaacgtgaacacactcatactaatgatgcacactccatacctcttctgacaaagcaaggaaatgagctaatctggaagctcagaccctaggctctgctgtgatgcctttgtccccatcagctcattcatgtccactcacggccagttaggccacactgaggaacacaaccgctatgtacaaatcctagttaggccattaactgtgtgacttgggtaggttacctaccatctgcaaagtgagcaacattatagtctctgcttcaccggaattgttctcaggattaaatgagaatacacagatagtacttagaatagttaggcacataataagcgctcaataaatacataaaacaattttggtaactattacttcctgacctcagcttgccttgtacgtaaaatggggttatatcatggttccctcacctgggtcctgcataatgtatagccctatgtggtaggcagcagaatagcctcagaaggcagggctgcagccatggggagccagaatacaaggaatgccctctgaggagtacgaagggtggtgcagaaattcccatagttccttgatatctcaagatacttccttgcagagaactggagagcatttgggacttcatagcttggccctagccaggtcattctctccatgggcaggtgtgagcagggctgctttttgaagtcaggagggctcagccaccctgggaaagggagaggggatgcagaataagctatgaacaccagtgggaggaagtgagatgagagtgaaaggaagaagtgggcagggacaagtaggcagcacaatccatcccctgtatttctagaatcaggctgaggaaaggactcacagatgatctggcccatctacctacctctgctacccattttgtggatgggaaccttgggaaatcctggctgaaaaataaatttagtcaaggtcagacagctggtcaacagcagagccaacactggatgagacccagggcttccaattccaggccactatttttctgcaacaacatacctggtcacatcaaaagggccccattgagtcagtgcgaaggacatgaggcttggagtcagcccaactgggctcaaatcccagcacgagcacgtcctagctgtgtgactctgagcaagtaaattaccctctctgatatgttaggtaggatgagttgaagtgctgagaagatcaaatgagtttacagtaaaacgtctagcatagtgaggcttcaggaaatccatgtaccttttccttccccagggaatctaagcctgggcagggggaagcctgtgtgccaagcaaaggctgcctgtgtgggtcgcaggggcaagtcaacccccaacctgtgaggaagggcaagtgcatctgggagacatcccgacacccacacaggctgaggaaaggactaaaataagtcttccctgtgcaccggggagaaactagagctaaaaggaagtaagtggctccgaggacccagagcaaggagcccaaccagatgcaccggctgggcccaggtttggtgctccactttccccagagaaaagcccagggtgacccccaagtctctagggtaggacggcaggtgtcagctgagcaggacggagtgctggccctatgcccctggagatctctggccctcctctgaaggctcagctcacatcacatcaccagcatcaggagtgcagggaggtcagccccgcttctgaggatgagcgggtgacctctgccctgggaccactgaatgacattcttgattatgtgtacggtgccctcagagagcccaccacagtctaggctcagctgtccaggggtgggctcctcaccttgggcaccggggaggagcagaatcaagtgcaggaggaccattaaaattgactgagcctgtgcatctcaatctttctgaggcatcggtttccctatctgcaaaatggaggtgtggggaggattaacacccagtttgtgttcctccagccagtgaaggaagcgaaagcactttgtaaataaacatcacaaagcagcggagtgtgcacattattgctgtctctgttcccctgctcaccacccacccctctccctccagaccagcctgtgcgtagaggtgcggtatcaggccacagacggcacagtgggctcctgggatgatggggacttcctgggagacgaatccctccatgaagaagagaaggacagccaggagacagatgggctgctccctggctcccgccccagctcccggactccaggcgagaagagcttccggaggtaacaacagcccaggctctctggccacccaccaccccccaagacacggggaagatgcctggtccctctcgaaggcccctccgggcctgactgggctgagagtccagggctgagtttctggagagacacaagaggcaagaaggtgtttctacagggccccccatgcttatcccccgatcccagggctcactcgggaggcctggtgtcggggatcaggctgagggtccaggcctcttgctaccctgtgacgagttctgggagggtgaactctaacttggggcgaagaggctagaccccctgccctaagagaatgggtaaagcagataggagggggccctaccctctctcgcccaagacccagtcatgccagcccagcccctggcagcctgccatccacctgggcccagtggaggcccaagagagggaggccttttcctgccagggtgaagccaaagtcctggtcgggacatagcctcacttctgttgagaaaaatatatcctggcccccctcagtgttaaggactcacacctgcaagtgtcctgccacacacgggtgtcaggaagctgtgtccaggtcagctcattctaaggcatgattttttccaaaagaaaatgcagttgtattaccattagaactcagagagacagactgtaggttagcaaaatgttggctgtagattcctaatccactggaaataatgtgtaacatgcaggtaagtcaacggtgtatctaaagttttagaggagaggatcccctcccagtgatcgcccccctccaatctccctttccaaaaaaagtatattcagtccctgctctgaaaaaacagattctaaatcagtgcaattgaattgataaatttttattagacaaatatgcttttctttgtacctgacccacgcccctccggccacacacacacacacacacacacacacacacacacacactatataaacctaagaccctgggagccaggtggagagcaatagtaacaaggtcaaaggagccaggagtgtggcaaatacaggggaccttgggctccaggccagcagggagcagcagggggtggcatcacccaggccagctgggagcctgtcctccttggactctggccagctagctggaaaggagatgcaatttggcctcaggaggcccagatctgagtccgggctctgcctcttaccagtctcgtgacccttagccagtcgcataccctctcccctgtccctcctaacctgtaaagtggggcccagaataatgagaagcactccccaccctgctgttaggagagccagaaggagcatggggggcacggggtgtagctggggtaccaagtgctaccccatacaaggactggtgacaaacagggtcttggcagctgaacaatgcaaacggtcaggaagggggctggaagtggtgacaggatgaacaggcacccagtggggaggcaggggccacacagagggtacgtctggtcccagtcctctgttcccacacaggaaagagcttggctgggactgtcagaggtgcagctgggctcaccggcaggggacaagactgagtgccacctgagggccagcaatacaggcaagggagcactgggcctgagtcaggggagctgagtcccgtgaagtcccatcctagctgccactaactagccgagtgactttgagtgagttgcctacccctgtgggccagttataggaatgggttgaacatcctggctcctccctaactgtgatatcccgaggaacccagggacactggatctcatggtagcacccacgtgaaacagctctgggagctctggacagccgagggctgccctctctggctactgtagtcggggatgcaaagccagtttctctctcatcctatgagaacaggccaggaagctgatagaaggggcacgagtggatacaccagagcaaaatggggagctgtggtccccagacctgcagaggtctcctcccatccttcctcagccattgctgggctttcctacctctccctgaccttcatgtggcctgtcccagggcagcagcaggaagccagagcaggaggaagggttttatctgggatagggaattgggagaagctgacaaccgtggtcagagccccttgtcatccagatgccaccgccccgtatgggaggggctgtgtgagcatgtgcatagtttcctggctgccgcaggggctgctggtccagatgctaagagcgcctttggggttggtgtctttgccaggcctagccacaaagccagcaggctgggtgtggggaagaagtgagaagcttcagggagagtcctttactggtgagaagaaggcggagctgttttagagcctttgggcttatcctacagcttcattctggctgcctccatgggtcaaagcacgcgggtggcaacaaggacttgatgattgacctcacggccctaagtgttatgtctcacccttatcatataagtgccaactagccaggcctgtcaactctggagagtgggtggaagccgctgtcttctggaccagagagccctccagaaaggcttggccagcaaaggggcagggagaggaaaggatgaatgtgcctagcctctggcccccagggaagtcttcccttcccgcgtctgcccctggccctccatcccctcctgaaaggcccacccctttgcagataaaggtgctccgtcgaccaagcgcctctctcatctctcctctggtccatcaccagccacaagaaaacctcattgttggcaaacagcagtgtctcacctggtcctctgttcccataggggtctggttagagaatccatttctgcctgtctgacttggctcagtagggtgtttgctggagggtggtggtgggctggtggagtgaatgggtggagaatagcctcagcccctggctggcagggactcttccatggatgacagaggaggctggtgcaaggaggtccaggcgagccatctggcctcaccaccccaggaaaagctctatagaggctccccttacgtaagggcactctatctcaaggcccttagtatcttcctggaaatttctcccagttgacctcggggaatgtgtgctggcacctctgcctgagcatgccctccaaaccccaacccagcctattaacccttccctcccacagttccatcgatcccgggccctggtcagtctcatcctttctgagcatccccggcctacttctctagtctctgccccaaaccaggggcccttgattgtggctgggtctctgtaacacaccctgggaatgttccaggaggtcatgtagtgccatggacagaacagggctcagatcccagatctgccctttggagccacacttccccacttccccacctgtaagaggggcatccctagtgcccctcaggagtgttaggatcacataagatgctacatgtgtattgcccactgtggcacctggcatgtggtcggcactcagccaatgtctgtcttccagagcctccgtgtcactcaccccaacttccaccctgaacactatctggcctttgggtccaagtcctgctattaagctccccctcagctctggccactccaccctataccaagggttctgtgaacaatgctgctgacacctggagcctcacagcagccggggcccagggcggggcctcacttggtcacaggggtcccctcgcctcccacagctgtcagtgtggcagagaaggaatgaattaccaaccccgtgggccctttgctctcaaaaacgcaaaatcagggtgcaggccttgcatgttgggatacatctgccccagtctctgaagggagaggagactttggtccagaacatgtatgcacacactcacaatcaccctggtgtttgcacacactcacgtgcacataggttctctctgtttgatgccagggagctgtgcacaccactgatttctgggatccggtgcagtagctctaggagtcacatcccagaaggaaagaaaggagccccagctttaatcttgcagctcctcttggggctttcttgcaaattccctctgttctgcaactctttcttctcatcttctccacctgcctggccctcctgcccttcatggccccacctccttctgcccacaccccctacctgagaagatagaggttcttatagggctcctctctgctgtgtctcatcttgggagcataaggagggaccacttttcttgttctcctcatggatcatcttttattccagcagagatccatggaagctaggtatccctcctacgcctgaggtcagagggcagagggatatcctcatggtatgtgtcctggggtatgtatggggtcagcacagccagcctcacccccagagctctgctttaccagttcccatgatcccttcccctgatgatccccctcatcaggctgagctccagagaggccagagctctcaagcagcgcagaggagccagggtcaaggccatgctgagatatgtggtgaagcagtgctaaagagactcttcccaaacctagccatttcacctgaggttggactcccctccatccccaacccaggattaagtgtttgtgtgagtcctggcactgtgaagcacttgggtcccagcaaaccctggagttccccagcaggctaccatattgaatctcctaccctgtgacactttcagtggcacacccagagcaatggggatgggggtgtgaggaagaagtggagtgaaaccaagccccagagaaagagaatgctggctggggaatagaacttacctggccagggtgggacagtaaaaccacaatgtagactctaggaagaaagtcagatccattcagggcttcactgagaggtcccctagcaacagggacagaggccagttcacatcctacccctattgctcatggcggagtgactgagggcaggctgaccacagaacctcgaaggtttattattaatgttggttgtatcctagtagtagtggtagcagtattttttcacagaaaaactgtccttttcccttctccatttctacactcagagtgtgggtctatgtgcagcccttttgtaggcccagaggcctagagcatgtgaggaggggtgtggtgggcatgtcgtagacagtgtgcactgggctctgagtgcaggtcatgctgtgccttggcctcctctctgcctgagcagaccccccactgagccagcctgatgcttcgctgagatttcagagcaaaaccgaaagggagagagaaaaaaacatcatgtttttattgttcaggtatataagttcccccttcctgttccatcctttgccaatcctagatgatacagtcccccttctggttcctctattgcaatatttttcaaacttttcagggttacagagggcttttaaaataataaacaagcaaactccctgaaaacttggatccaaaattcagagaaaggtagccctgtttgggttaatgtgggggggggcagtaaatctcctgttcagccctcattctcaaaagctcattggagctcctgctccactggagcacaccccatcagctctcagtgggtcccagtgcaggcccatggccgtgcctggcctacctgcccccaagaccagccaggcctggggccactgcgggcctgctgagacagcctccccttctctgcagtgcactgttctctgatcagtggtctcagcggatttcagcaggcagagacctggctgacgttgattactttgaaaagaattacaaactgaccagcttgcctaatggaaaagattactggccaaagctgcacttcagctgtgatctatctaggccttcaggttctgagctgtcagggcacagagtcatgtctatgtgggcaaggcctgggccagtatagaataaggagaggtaatatcactaactgccatctgctttcttttcttcattctctctgccacagcatcagggaagcattgagagaacattccagaagggttttctgaaagcctccctaaagaggcttaccctgctctgagccccagagtggtagctctcttactgccacgtgcccagaatctgcccagcctacctttcctctcagaggcccccagagcctgggagcggcccattctgttgggaggagatgagaggaggaaggaggtggggaggagcagggtggcccaggcctagagggtggccagactcctagaaccttgctttccctgaggcatctgagacccacattagaaatcaccagacccgggggattcctgggtggcgcagcggtttagcgcctgcctttggcccagggcgcgatcctggagacccgggatcgagtcccacgtcaggctcccagtgcatggagcctgcttctccctctgcctgtgtctctgcctctctctctctctctctctgtgtgtgtgtgtgtgtgtgactatcataaataaataaaaattaaaaaaaaaaaaaagaaatcaccagacccttgcctggaaatgaaagagagcagctgatccctgaggcctcctccctgatcaaggctctaggctttcctgggcttggcgttgggcgagtggccacccagccctgctcctgtgaccagggcagagcctgggactgtctgatccttgccctacagtcttaagctgaagtgagaagctgtggggtgaggggtccctgggtcaaggaggcccctggggagtgggggtctgcagggccaggggctaagtctgcaagtgtctctagtccacaccctcctcactcacatccccttgtctcctcatttctcctcccccctactcagcaaaggcagagagaagaccaagggaggcaaagatggcgagcacaagtaggtgtcccaggccagggcggagcccgtggggcccaaatgcttctcaccacagggtgcggatgtcgggatggcctgtctcagagggcttaggtgtgggctatcctggtggagccagccctgggggatggcagagcgagggcggtctgtccatctggccatgggggggtgagggccagggagggagggggtgggagcggggggtgggcaggtgtctgggcctgctgtttccactccctcctgcctcttttcagtgtcttgactcttcttccacttccctatccagctctgtacccatggaccaggcccttaggcttccctctgagggagggtatgactctaggcagaggagtaagggaggctcaagaagccactggccacttccccctaagagtcaaggcagggctgggcaggtggatacacaggcctggaggcccaaggaggacagactctgggcctggagtggccataggggtggctggagcatgaaggcccagaaagctaaggggagatgagcagatgagcaccttctgtttgtcctcaccatctccaaccccgaaaaggcttcctgtgagagggagagatcagagggagaggagagaggtggaaaccccagatgagaggagctggccacaggagcttggaaaacctcatggcctggggttgatgagtaggtctcacagagtcccccagaagcacatgccatctcaagaactctctagcattatggggaatccataggaatggtagcagtcagagctgacaagctggagggggcctctgggccaaagccctttcttagagatgacaaatctacgtcccagagaggggaagtaacttgccccagaataggatcagagctagaatgacaacacagggaatctagcttctgacccagagtttacaatagacccagggagtttagagcacttgactgtactctaaattcaatttaactctccaaacacactgacgtaagctgaaaagccaagcgtgtggtctttattttccagacagggaaactgagcttcagagatgttaaaagatttgcctcagactgtggtgccaataagctaaaaaaccagttgacatgaggacatcatggggacaccaggattgtgccaacaggggtctgaggtggtcagcacaggtatgggcttgagatctctgcttgctttaaaaccccagagaactcaccattgttgtccattgccttaacaaaaacatactgagttccaactccacttgtgacacacaagcaaaagcacaaaagcgatggcaccgcgtggggaaagttcaggccccaccacccgaagagtcaaggctctgagcgagggaaggcctgaggcagagcaggtgccaggcttggagtgggagcctgattgctgaatccaggggtatgtgagtgagagatgatggcagatgctggactgggagtccctcttagggagaggtttccaggggtcaggttcctgcttggccgcttagctgtcaaaggcctccttaggagtgtggaccacctgcccctcccccaggctctgacagagtggtgaggctctacggcacttcccggctgccagctccccaggctgccggaggccagacccccagccattcaactggttcccgagtgctccctgatccgaatctcttgtcatctccagttaactcctggaataaagtcacctggcatttttttattcttatttaaatgtgtagagcagtcagaggattgaaaagggaggaaaatgagatttctaaaaagagattataaaggaattgaagggatccccgggtggcgcagtggtttagcgcctgcctttggcccagggcgcgatcctggagacccaggatcgaatcccgcgtcgggctcccagtgcatggagcctgtttctccctctgtctgtgtctctgcctctctctctctctctctgtgactatcataaataaaaaataaataaaaaaataaaaaaaaataaaggaattgaaactcctctgcctggggaagaaaaaccataaaaacaattttgaatctctgaaagggtattttgtggccaggctggctaggctggagctccaccaaggagaactaagtggaagtatgtgcaagtcgcagtaggaagaactgaaagagccagccatgaaaggactcgtgctccctgtgggtgcgtgagatgctgggagaggctggcctggggaggtggcgctctgttcccatgatgctgtttacttgagtcttgtgaggggttggccacaggggagggccgaggagtcagctccctggtgaactgtgagcctcaggacccaagggcctcctagcttcctgctttccccagggcgcatgggtaaataggccaatcaggagacaggttcttataggaagggtcgacctgtcctgcccaggtagaggaagatatttgaaactagctaaacctcaatacactgtgagaaacaactctacagcctgtgattatgaaattagtggtacttgggacatgaggggaaaaaaaagaaataaacccaccaaggggtactggtggcacatgcccccaaggtttgaaaatgtggctgtttaagcaagcagagagccagagaccctgtttcgctcaggcaggggttcctccaaattacctgaggcctgagcctaggagcctggattgtgaggaagcccaggcctgcagcccactgtctgcacagcccctaagtacgacctccagaagaagacacagccctgaattactccaacgcccggttcactaagcttattttggccaaggttcccaagtcattttgaatatcaagctctcctccctgcagggccccaagtgcatcacccaaccacgacatccttctagatctgagccgtggaaccagcaaataaatcatcagacccataaatgaaagaaaaagtttacaaatgagtgaactaactttaaaatcttttctctagagggaaataatggtctgcattgtaggtgcatatcattctgcctgcagtaaatccagccacggggaaacctaaatgtgaccataaatcctcagagggcccaaagggcccccctccccagctcctgcttcggctttctttcctgaagcgatgaatgaggagcaacttggtcacaaagcagtttttcactgagttgattactggctttttatctttgtctctttctcaccatattgtatctttagtcattgaagaactcaattagaccgaaggcagcatttatttaaaaacaaaaactcagtacgcgggcacaccagtaacctcatggatagattacacattttggaaatctaagtctttaattcaagtggataatctttgaagaatccctgcctctgttaatatttatttcaaaaatcacctttaccctttgccaagagaagcaggcatgctgcttctgggaagtggtgcagtgataggcaggagaggctgcttctattggtgaacttctgaagtgtcatcgatcagaaaactccgaagggcagggagagccgacgacatcacactctactgcacactgtccagatggacttaagagcgagtctaggagacagaaacaggtggaaagccaatagtaagaattctggaaattacattcaccctacacattctgcatttttcatgaaggaataaattgtcatttggagacatttccagtatataggagtagcatcggtaaacctgtccacttgagatgcttaaaattatgcagggtctgagaagtcgggtttctcctgtgattggcttcaggttatggtagagaatagcaggatagtagagtttgttttgttttgattttaaagtatcaatttttacttccaaatatgtttcttttagggaagaaaatgactttcaaaggccgtaagtgcccccaagggaagccccaggcaactttccccacttgggtgggtcctcagaccagcatcagaaagccacaattcctagccactcgagccccctccaggcctcaggtagcacatcctgttccaggatgccaagcctctggtttctcaggcagggcctgcttctgactcaacacagtgctttgacctaccatctcagagcactttcccaggagctttatggcaaggggaacaggatgggggtgggggtgggggtagcaacccagaggagtgggggttgaggagcaggctgtgtgtgatagcattgtgtaggtcacacagagtggggctggggactctaaggatggcacagcccagaaatgttcaagaagcaattgtaccaagtcaagtacagagccgtccaggaaactcccaggtaatccaggaaagcgacagtcagagcaggaaggctggacagaatggagccccaaacactgagacaggaagcaaagtgagggcttacactaggcacatgttctgtggcaggggtcagagtactgccagtacccctgctccctttttttttttaggattttatttatttattcatgagagacacagagaaggaggcagaggcagagggagaagcaggctctgtgtaggagcctgatgtggcactcgatcccaggatcatggcctgagccaaaggcaaatgttcaaccactgaagccacccaggtgtcccagtaccccaccttaaggccaccaggcaaggaaccatcccacaggtggctcagcataagccaggcaggatggtctgttctcatagccactcaattgttcctgatgaggtcactgacctgttcaatgttttgtcaccagtcattaacgttcatggcagtctcttccaaaatgcatcaaggctgagaaaatctgtgaacaagccccttctttgtacgtaaacctgggcagtccatgggactcttcacagatggtatccccatctgcaggctgtgctggcacgtggcccatacctctacccacaagtgcaggccctggagacttttcaccagagttccaaatggttacgatgggatgtaccccgatggaggagtgcaagcccagagcactaagggtatagtagtcgccagccgaggaggtgggggctctgcgcttcagccctagtgcttggagcctgtgagtctttctttgggttgaatgaagaaaagtgtatgtccctcccaggattgttatgaagaggaaatgagcaaacatctggaaaagtctctggctcatagtaggtgctcaagaaaaagtatgtcatctcttgttggcacatatgtatatacctccctccattagaaggggagaaacttcccctctcttccattgttataatccagacagcatgatgctggctagtgcggacacattagtgttaccccagcctttcttcccccacctcatgactttttaggaaaccatgaatacactggtgttttctaaactttgaactggtgcacaaggaagggttcttggttgttctttcactgggatgcagactcacagccttccatatcttgcctgggagaaaaaaaaaaaaaacagcaaagatttaagaaagtcctggggttggggtagggccagatttgggggagtaagattggtccccaacctcgagtagaggggcttgaagtttttaggccatccctacaaggacagaaaggttttgcccaacctcacattacccggcataaagatcagggggtcttgggaaccatagtcaagcttccacagggagatgcatgacccaaaggtgggtgggctctgctgtaggtgagctcagagttggaacctccatctcgccccacctgagcctacagggctacacccaggaggagggagaatgggaagaggaaggagtcaggtatcctgctcatgcaatattaatggggtaatggaatattgcactttaccccctgctggtcctactccgggtccctcctggcaccagggacctcgggctcggctgcagggacatcactgaagggacactgacggcccctgcccccttccctctgcccccctgactgcaaggcccttcacctggggcacaaggccactccaagccagagaaagaggtaggaactatggagtctgccatatgttcctgggggttggttgaaagagggattccacagtgagcggggacagacagaaggggtggaagccagcaccaaagatgaatgggaacgtgcccatctcctccctttcacagggacccaggagaaccctagggcatggagaggttgggaaagacaaggcaggctttgagcaccagggccgtttgagaaccgagccgctagtttccaccacacctcctgcttggcctctgcccctctgcccctgttcctgtccgtctgtccagacgctttgtctccggtcacctggctttctttccaacccactggggaggatgagctcggaggcaccttggcgctcagagctctgagaccaggctgagggcgctgagatgggcccaggacccgggagggctccacttaaaacctttctttgcagccgaaggtcaccttctctgatcgctgggccctgggctgctcctcggcggtgtgaaggcattggggggggggggggtcctctgccctaattccccctcctggctcgcgcttgagaaagtctggcccccaccctatctcgggaccagcacgtgagggctggagcacgaagctctctctctcacgtgttctttctcgggttttgctgtcctgtgtgtgtgtgtcttccggcggcccgcctcgcagagccgggagaagtgtgttctctgccatgaagctcggcaagaaccggacccacaaggaggagccgcagagacaaggtagggacgcgcgccccagccccggccgcccgggccatccctcagcacctgacggagaccaaaccccgcccctccgcgggccgcgccccagcgggctctcctgcgattggctgacgcggccacctgggcgggccctcgcctcccattggcggccggaggagccgggccctgcaggtggtctccaggaagggggcgctcctagcagtaagggtgggagggcatctccgcgggtagaacggagcagaaggagcagaaccctctgtggatggatgggcctgtctctgccctctctgctctctctcccttttttcctgcacgcaggagcctagaggttgttcattagggaagggaatcacaaaaaatgaaagtggttgggctagttccctatttctggggggaaaccagcatcctgagcaatgcttactcagggccaggactcactgccctgcctttccccttctcaccaggctgcagggaaggccccgaggaagaggggcggggtgggggcaagacaggtgtttggaaggaggcaaggaggacaggcaaaagacaggggaggactggatgggtaagggagctttctgacccaggtctgctgatcatgtgtcctccttcagggctcctggctgcctccctcagcatcccctgtggcccactggccccagcatctctctcagtcttgcccccacaccagttctacctgtgcccttctccttagattggagagggtagggctgctggctgaggcctaaacccaccatgcttcgggtgatttcccaggatggccaattctttaactccttggactaatacacatcagtgcagggttggttccaaacaccatcactccatcaactcttttacatggataagttacttcctaagcctcagcttcccaatctgttacctgagaatagtgcctatcttgacaggacatggatatgaggacaggaaatgcatgtataaattgcctggcactgtgcctggcacttagaggccattcaataaatggtcaagtagctattgttcaaaaggtatgtaactatggattctttttttcctaccttcatccacaaagggtattcagtgtttatatggttaatatgtaataaaaagttacattcaatcaaaattaaaaaagcaagactaggggtgcctggctggctcagtcagtagagcatgcacggggctcttgatcttggggtggggagtttgagccccacaatgggtgtagagatagcttaaataaataacttttaaaaagtctttttttaatttttatttatttatgatagtcacacagagagagagagagagaggcagagacataggcaaagggagaagcaggctccatgcaccaggagcctgatgtgggattcgatcccaggtctccaggatcgcgccctgggccaaaggcaggcaccaaactgctgtgccacccagggatccctaaaaagtctttaaagggtcacctggatggcgcgtagttagttgagcatctgacccacgtcaggctctgcactccatagagtctgcttgagattctctctctctctctgcccctcctgctcactccctctctctctcaaataagtaaataaatcttttttaaaaacattttaaagattaaaataaaaaaaagactagatataatatcaattaaaatcaaagatcgagattaggtaggcaacactgcagatagacgggccataacattctaagcaaagggatccctgggtggcgcagtggtttggcgcctgcctttggcccagggcacgatcctggagacccaggatcgaatcccacgtcgggctcccggtgtatggagcctgcttctccctctgcctgtgtctttgcccctctctctctctctctctgtgactatcatgaataaataaaaattaaaaaaaaaaaaaaacattctaagcaaatgttagacctggttcacccactctggttgttagtttcctggatgccaaagcaaaaggggaaagacagtcactatcccaccatccagtccacctaactttcttctttggcagatgaaccggctgtgctggagatggaggaccttgaccacttggccattcggctgggggatgggctggaccccgattctgtgtctctagcctctgtcacagctctcaccaccaacgtctccaacaagaggtgagtatgcaggagtctcgcagcccacactgcctctgccccttcaggcagggccccactgtgtgtagaattgaggtagcaaagaatcagggcccttggccagcttcttcctaaccccgcccctttcttttcctgaatgtctcacacctctgtccctataaaggcaggagcctattctcgggtcactgaacacctacaggccaagggaaatcacagaggtgctcagcacacatctgaacctgttgaccatttaatacctatctctctgtcacttgtgccattagctcatcgtctctgttggggcctctgagaacacctaatccccattctgtttgatagtcctggagtgtttgaagaccatgattctgtcctctgccctttgccagggttcaaccactgccagagcccacctcctcccctctacgcagtccccttacaccaaacctgacagtaccttctcctcctcaggtccaagccagacattaagatggagccatgtgctgggcggcccatggattaccaggtaggtggggcaactaggggctgtatacctttcaaactctagtggggacttctggccagatgtgcattatagactctctggatgcatggatctgagggtcatagagaaccacaagctgaatgtaagtttccaaagtaagcttgtttgtgggaggcactcaggagtgtcctaactagagaggtacaacctacagaggagcttcagaattctgcttctgctggtcaaagccctctcaggatttcacttccagcagtggacttcataaagttagaggaacccagaaaaaccgtaaaaaagatcaggaagcaccactatatatatattccaacaattaaaataagagcctgtgaagaaggatttttagggggtgtgtttttcaaaatgtgttgttttctattattttaatgcttgaagtaatgtcaatcctgcttatccatagatgatgagaatgtgggtggggttttttctttttctttcctgtgttttctgaaattaacacttaatttttttatttgtaagtttctaaaacttgagacaaaatgactgagatagggagagatttgaagccatagaattgttgatatagccacagtgcaggcagggtgggtcatgaacatggctggtagctgctgagagagggccacacaggatgcccgaatcccagtgcagccctccgagcctgatcctgagcttggcaaggccacactcccagttttgtctttttgggcagagttgatcagagcctaagaaactgagttacattaagacaactcacaatagactaatgtacaaaccagaagcacctagtacttatttataagctggaaacaagagggtccatggaccacccattgctctagaccttcccttgggatctaacaagactcagctttaggtcagaagattgtgggcattcctaaggctgagtgaatacattcactggtcagaggaaacagagccttcgggagaccccacctggctgccactgtatcagaaccaggtcctagaatcggagggagcctcctcttccaggttagagctgtatctttcatactaattgctcagaccccgtgtgtaccctttgttaaggacagctccctcacttccttggtataaaggaccaggaggcacctttctttgtatcagtacatctggtcgtgttttctcaaggacatccattgtctcccgtaatccttgcttcagtttgttttcatccagttggtgaccatctttccaggtacctaaaagttagcctcaggcagcgattttagacagcctcaagcccttgggctcctgggaggtttgagaatgtcgctccctcacgattccaccaaaacccaagcatcaaatatcttaagacttctggaggctttgcttctccagaggactgggttcagggctttgctcctctgttagttctaagaataggaaaatcccaaagaacaaagacctgcttgtctttgttttcagatacggttcactctccagtgtcaccagcctgccacataaggacacatggaaaatagggtcattgttgtgcctgttaacataactgttattttctcaaaggcttgctatgagccaggggctatgctggatgctgcgtgtgtgtgctttccatttaagtcaatgtaattcttagaaccatccaagtataggtattactacatttcttttcataggtgagaaaatgagacatgaggagggtaaggagcttaccccaggtcacacagttattcaaaggtagagccaagattcaaatccaagtgtgtccaaccgaagcagtcagagtgactaatgtctctctaattgagcctttgggacagtcacccactctggtccctgttcatctttaccttactacccactgcttttttttttttcaaggccctttcaaaatgctttttaacagacttttgtcaagtgaaccacactttctccctccaaacattcacattctgaactgaacagaacggttgctgcacttaacctggtaacacagtattttctggcaagtgtgttcacatctcaactacaagtattaacacacgttgagagagagctcttgggatgcaagtgtggacttattcttgcttccgataaatacaacagagaaggcgagaaaacttatcaaaggaacgtcactctctggagaccttggcttcacccagttgggaagagctcagaaagcgccccccgctggtgggaggagagggtttagctgaactcagatccagaaaggaccctgatggctccagtgaacagaccatggcttgcctgtcccctttgtctcttctggttagaatacatgtcacatgtagtaaaccctttcctgattattagcatctcaaaggcaagaagccccagcgtcatcccagtaaatagacagcttccccatcagagtgagcgaagctctcagcacttggcagagatgttcttggtgctcatggagtcctgagcgtgctccctgccctctcttcccgcaccaagactcaagatcacctccgtgtcctctccctgactgcaacattgcacccattgcctagctggtctccccaccctcgtagcgcctgcgccacaccaaccgctgcgccctgtcacatctcagccaccagagataaggaaaggtagacggtgtttcagaagggccacactggtgggccctgccagctccacaccaatgttctggcagcacagtcagatcccgtggaagcaggtcacagaacgccaagactcttgggttctcccaaggacggaggtatagatttacactcagccttgttccttccgatggctttcatgaagccacctgaggattaggtcccttatcttgaaaggagagggctgaatatatgattaccaagagtctccccaatcagttggtcagtcggtccctttgtgggtcaatttgcctccccatcttccaccctggaaagatcaagtcctctgctgatgacgggagaaagaaaggatggccaatcccctcctcaaaatttggtttatttctattttttttaaagatgtatttatttatttaagagagagagagtgggggggggtgagggagagagacagggagagagagagaaaatctcaagcagactacccactgagtgcggagcctgatgtgggggctcaatcccacgaccctaagatcatgacctgagccaaaatcaagagtcaggcactcaaccaactgagtcacccaggcgcccctcaaaatttgtttaaagtttcaagtccaagtgatatatttcccctccgtatagccccaggtgggggagggggaagcaacaggattgatgttcccctccaccaccaatgccatgcaatgatctcaatggtgcactttcagggttcccctcggggtcacccctcagccagcaaagagcaccctctggagcctttcttttcccacccctatctctctaccagctcctttaagccctctgcccccctcctctccccagccctttgagttctgaaaaggaatagggggccaaacgctatcatcatgactgggcttctggacaaaaaacaaaaactaaccagctgctcacatttggaaggttaatcttctgatggcatatcttatttccttatcacaccaaaactgtgtctgtctacttcccagtcttgaattacattctttttttttttttcttgatagaagggagaggatgagttagttgtgagaaaatatgacgagattttttaagtctttgccataaaaagtttcatagaggtttaaatgctatgaactactatgcaagaatattctggaaagacttctagtgtcagcttactctcttcacaatcaacttctcagagcctaagttaattagctctatttcctttttagctctctaaagaaatggtgatcattaaacttcttcagagctctggattctgagcttcattccctttggcatttcaagttccaaatagaaatgcttgctttcgtagttcaagtgttacttcaattagtaaatgttcagtttccagttctgtatactttcttggcaatgttctcactggcactgaagtttctatttttcttaacatgattagttttaatgtgctgatttgtcttggccttcagaatatttataagactttgatggacacggtggatgatgattttcatagttattcttttttatgaaaagggaaaataattttcttgagtaaaatcatatttagaagttgcatcaaagcacagcaactgatacatcaaatctccaagatgagaagcataaaagcaacccctacagtttcattagaagaatgagctgtggtaaatgctaacactagcttagcacaggctattttgttaaaatgcaagttcgagagagtcaaatgaataatcacaaacatctacagaaccctacatacaagggagactctgagaagccatttataacaatagctcacattttctagagctttctactgttcgtgacgcactttgacacacagtacctcatttaaccctcacacaaccttatggataggtctagctctgtgagcctacatggttgtctcctctcacacctggtcatggagaaggtctggggcttgtccagtgccagcccagacacctcaaatctgtccctctattttgtcatggccaccccaatgggaaccaacacctttaaatccaaagtaagaactgattgcttagaatgaagtttcaggaggggctgaaacctgggggggggggggggtgctgttggctaagcatctgacccttggttttggctcaggtagtggcctcagggtcatgaggtcaagcccggtgtcactgggctctgtgctcagcagggagtcttcctgggactctgtctccctctctctgctcctccccatctctctctctctctttctccctctctccctccatcaaataaataaataaatctttaaaatgaagattcagaaaaggtatgcacacatacctcccctcctctgccctgtatacacacacacacacacacacacacacacacacacaaacatttgctgaatgaacaaccgaagaagggcttctcagcataggtgtgagattccagggagctggacgccacctgaaaagtcacagagcacacggcatcaagccagcaaaggtagctcaggctcccaaacaaattgtacaaaaggatgaaaccaggaatgtggaaagggggccaaattccagaaacacagagaactctcagaggctttcaatcttggaatgagatacactggggcaggaaattaaatgcatgttaatgaagacatagatagcttaatccctgcttgcatgaatcccgggaagtggtttgcaggcctctatgaggccgagccacagtggctgggggtgtgaggagcatttgaaatcaccaggagctttaaaaacactgatgcctggtccccactgccagaggtgagattggcttggtctggagtttggcagggacaccagcatttttaaccagcaccttcctccttgctggtaattctagcacacacttagtggtgatccagtccatgcctttcctttataaataaagacactggggtttagtggggaaagagccccaggtccaagcagattagaggcagtgttcaccctggaacccacgtccagcactggctccctgctcctgggccccgactccaggaggagctactccgagtctcaacaggcttactcagcctccctctcctgcccgcaggtcagcatcactgtgatcgaggcccggcagctcgtgggcttgaacatggaccccgtggtgtgcgtggaggtgggtgatgacaagaagtgcacatccatgaaggagtccactaactgcccctactacaatgaggtcagtgccctgtggccgaaggtggggaaagggacttccctaaatgtggcaggaggcctggtccccgccgtttcccaggccagagccccttgggggcagtggcaccattaaagagtggttcctgtgagccaggtgctcctataaatgctgcaggggtgtcctctcttctggcctcggcaaagatcagaagttgttgccattaatcccattttataccagagaacatggaagcttctggagagagccctcgcccaggtgctgagggccagagtggggttctgtgtgcgcaccctctctgctgggctgcctccgtgcttccagagcactggccttgactcttcaaaatgacagaaaaaagcctggttcctgctcctgttctttgcagccatctgaggccacactgaggtcagaggacctcagagaccttctaattccatctccccatcttacagaggaggatactgaggtctcagtatgaaaaaggccttgcctaagagcacaaagagcgctggtgatgaagcagggcccagcctaccagcctcagcccagcactctgtctaccactttgagtggccacccctgacacaagaccttgacttagggctccagcagggaaccaacttaatcagctctagtgagggatgcccaggagcccttcagatgcctgagcatgggtcagactggcctgggggccctagccctccttctcctggggggaacattcagtctgcttgtcatgggggctccaggcagtgaaggtgccaagctagccagagtgaggcatccttgtcctgtatctccatgtctgtcctgaggagtggtgagggctgagggtgccaccgaacttagggggagccccccagctgcgcatcagcaggagggaagcctggatgcacttctgtccctcacagggacccagaccagggtcctaggtgaacctggttctcacagctggttgcccacagggctgggacatctgtgctcaggaaacacctgcccccttcccccagccccatatggtgacctttccaggagtcaggaaattcagcctccacacctctgaccttctatctggtcacatccctgactataaaagcctccaacctagataagaatctgctttcctttaatggatatggagacaggtgtccatggccttccacggttattcaatagtggcagagccacattgagctgactcaagggctcaccttgcaccaaccccacacacctcatgcttctttcagagggcttcctccttcccaaggaaacagccgttctccccacactgtttccctgcccaactcctactcaccctccagagcccaggccaagggtccatgccgctgagctgccttacctgtgctctctgggtcagaagtcaatgcacttctttctctgtgacaataatggccctgaattgtggttggtccctcacgtctctgtccctagtgtacccagtctctggcatcactgtggcccagcccagagcctggcttgtacctggagggttgagtaacacattgcagaatggatactcccccaaaggaagcaacgaacatttgccgagcatgtgctgtacttggagcccattcctggcaacataggggccacagaggtgacagtctctgccctgacaggccatgtctacttccagcctagtaaccactttccaattatatccactaagaccattccttccactcccgtgagtcttaaatctggatcatagtttcgtttttttgtcacaaatccaaatagctctgatttggttaatttctgtttcttccaaaccagggattctcaaattcagtactgtggacattttaggccaaataacttttggtgtaggggactgtcctgtgaattgtaggatgctgggcagcatccctggcttctaaccactcaatgcccgtagcaacccccacccagttgtggcaaccaaaaatgtctctagacattgccaaatgtccccctgggcttaaaatcaccccgttatgaacaaccactgcttctcctgattcctctggtcctgaagcaggctttcttcccttttgcttcttgtccaataccacgttcttcttcactgaaaaatacccttggtgaggcgatgctcctcagtggctcagttggttgggcgtctgcctttggctcaggtcatgatcccagggtcctgggagtgagccttgcatcgagctccctgctcagccaggagcctgcttcctcctctcctccctgctcatgctctatctctgtctctgtttctgtctctctcaaataaaaaaataaaatctttaaaaaaaaaaaaaaggaagaagaaaaatgcccttggtcgcagaagtttacttcttctggctacttctctgagttagcaggaactttccttcacctgcactaaacacaatagagggagatgagagcaatcagcatgacttagacttttaaatggttatgaaaggggactacactcaggaaacacaaggactatacccacagagtgctcagagtgcagagttcctgctctcactcagccggggggcttgcccagggctgacacagctggcctggcctcgcctcttgcctggctccagacctgtctccgtgtgaagcgaggcttccaaccactgacttcccagtacaacctgaccatccaagaccaggccagggccccttctccctgggtgcatctggtcctggccactggtgtcttccttctgcctaaaccacctctctcctttgcccaggatccttctctttcttcttcccaaagaacctgacatcacccaatctgcttagcacccccaactctgcctttactttttcttggctccttttttgcctacaaggtgttctactcccatgtattctccccgagtacaactatggaaaaccccatatgctcagggacaggaactaggagtttgtccatctgtctgtacacctgtccacccctccacatagccaggcctttcccaatccctcatacttctgtcctccccccacaatccaattccgtgaacagtccccactgcctcttctccccatcatgtctccacctctgcccctggcttcactgaaactgccttccaggtcatcaaggaccatgtcatccctacgtgcaagtccacgtcgcccctctcttttgactgcccctccatttccagcctctcaacgccccctccagccaccccctccctcattgtctttcctgacacactccctgtcccctctgctgaaatcctgctgcttcttggaggcctgccctagatcagtcccttcccttactctcctcgggtatctccgcagtcccaaggggttattgccacctgcattggtctagatctccacccatctctccagagcttcagcggcccccagccacggcctcctgcacgtatttgctgcacacacagcagtcaccatgtaccatgcactgaccacgcgcgctcacaggctgaacacttgacaggggtcaactcatttagacttcacaaccatgcctcccagacccctttggatgggccttgagtattaaccctgcatcacagggtggtaaactgaggctcaggaaggaagtgactggcctgacggttaaagctttgtctggcgctaaaggcagcacttgtacccacagtgctctagcaggagtctccagcagccaggatcagactctcctcagacattggccctaggcatgttggcaacactttttccttgtctctgcccacaaattctccaaagcagtggtccctctgtggccgcaccccctcctcgttcccgaccgacacctgcacagcaaggccaggagacgtggggcagggagtgagtggcagctcccagctcaagaggactgttcacacccacagcattttatatttacagcaaattaagtcgttcacacctcattttacatttaaacattgctgaaattgggacacatcttctaggcagtggagcattgtggtttaatgaaatgtctgtgttgcctgtataactgcaatgtatattatggtatcatgtaatatctctcatcataacaagacttatctctcatcataacaagaccctaggtgggtgtctttacccacattttacagcctgggaaacagatcagacaatgtgttgctcaaagccacacagctcccacctgccacaaagtcagggaggaccagtggttgccactgctgttcatctaaacttcggggtgcaggggaaatggccggggtgctggcaggagggaggggcccggcactgccctagccaaggtcagctgggtgacagcagctctgggttgtccccaccttccagtactttgtcttcgacttccacgtctctcctgacgttatgttcgacaagatcatcaagatctcggtgagtggggagtagccctggcaggcagggccactagcttaaactgcacctttgtgtagacttaaaaaggggatccctctggatggaccaaccactaaaagccccattcccagccctatgccccgacacgcagccaggcaagtggggcacaggttgatttgggcctctgtcacctgtttagccaggtgcctctgtacagtgtacaacctactcacccgtacctggcagccaacaaaaatgagggaaagagggattaatgctgagcctcagcaagctgcccctgccctaccaaataccctccaagaagctgttccccagaaagacaggtggtgccaccatcagaccaccccatccctaccctcatggaaagcctcagccctgcctggcctgactggtggctggtggttctgcccggaaggtgattcactccaagaacctgctgcgaagtggtaccctagtggggtccttcaaaatggatgtgggaaccgtgtactcccagcctggtgagtagctgcgcgattcggtcagcatcagtacccacagctccgcgaatgtagcacatgccgtccttcccaccctgacagtcctggggcctagcctggccaggaccataaactgagtgtgaggccgttgggtgtgtggagtgatggggtgtccagtctgcacatggatgcggtgactacctgtgctcaggctgctggattcacaggagccctgcggggtgtgcggcattgcccccgtttacacttgagaggcctggggcctgaagaagcactggggcttccccagtcacgcagtccgttgggggtgaactcaggctgtatgactccagagcacccactgagccacactgtcctcaacacaaatgtgttgtagcagcctctgagggatgctgggctcactgagcaactatcaagggacccaggcctcctgaggatagccatgcagagctgtggctgaccagcagcaatgtgggtccccaggggccaacagtggatgaggctggtgagaaaatcccaagaggtggcccagagggtttatgaggcatgggacaggcggaggaagtcccctcagcctgcaagatgatggctaagcccatggccagctcaggcccatcctggcattgggccccacctcatgtcccaggagtgaacccaccactgaggatgcggtaacgactgcattaggctctttgacagtgacaatacagtttcacccggtgtcacacttgactgccacaaaacagtgaggtaggagacatcagcgttccttccccttttacagatgagataaatgaagccaagagaagttaagtggcttggaagtgccactgaactattaggttgaacaaattggcaatttcttgtggttcaacttagtagacacttggcctgtgcacactctgcgactaatactagggaatcggaggccaaacccaagctcatacacatgaacatcacaagctgcaagagatctgaaaacatagagtccagcatctccatatgacaaagaagcccagggttatgaggagacttgcccagcgcctcctgggaatagaacttggtctcccggctgccaggccaatgtctttcccactgacacacacacacacacacacacacgttgtaatccaagatggccctagtgaccattagcatcttagaggagtgggaaaggaagagggccagttttccatctggcacttcctaggaagcatgcccagctgcgggccatgggctggggtggaaccccagggctgagcagtgccccccccccagtaccggtggcagaggtttggagagacagcaaggagcctgacatggagatctgggcttctcagcagtagagtcctggagagaagccactgccactcagggagcacctgctaagcgccaggcactggggcagccacgctgtgctggcaggcttaaccctcactgccctctgtgggccacttcactccaagtcacaagaagaaagcaggcccagcaagcttacatagctggtccagggaatggaaaagaatgtgaacccaggaccaggtgggcccaaagcccaggctctccactgggcaacccactgccagacttgctgcttcttctgaatatctgttcctgagcctggtacccttcataggaacctgaagtcataagacccccacagctagggtactgatgtcttcactctgatggtctctggcttggtctgatcctccccgagagtccctcattgctgacctagccagggagtcattggaaatatgctgcccagggacacaggagtcctgggtgctactgggagccttgggtggtatcaatatcttgtggagctggaagggtttcctggggagaccagggcctgttatcaccctggcaggaccattttgcaccatcagatgcagcagcaggacactgctcactcactaattccctctgctggagataaggaggggttgtacaagtctacacccaccctttggtagatcacagaggaagtccggggtgcttgcaatctcctcagcccaaccaccttccctgacgggtgtctgagaagtttgagtatggggaggggtaagaaggaggcccttccaagctcaaagaacagcagccataaaggcaggagggtatgaacagggactccagtagtccagagaggagtaagcagctaggcccagagggagcacaagggtggggagggatgagtggagtgagccaggcagagctgaatcaggaggctccacggaccacactgaggtctataccccaagcaccggcgagcccctggcgtttgaaaggaagagccagggaaggggaacctctctgaaggttctatctatgtaggttgtctgcaggggtgagggcaggagagctgcaggggtttggagagttctctctcttcaaaatcacaccacacacccggacacaagaccttgccctggctgctcacccctctggggaccgctgtcttctcctggtcatcctgggaatcaggggcagaaaagatgctcagctccgcagctcctcaccctgccccagggtgacaggtgcagtctccactcctcacccctgcagagcaccagttccaccacaagtgggccatcctgtcagaccccgacgacatctccgctgggctgaagggctacgtgaagtgtgacatcgctgtggtgggcaagggggacaacatcaagacaccccacaaggccaacgagacagatgaggatgacattgaggggtgaggctcccatatacctccacccagcccctggagacctgacccagccctcccttctcccaaaaggagcccctggagtggacttggctcacagaccctaccccctgtacctcccactcccagacagctcagctcttccaagaagaaccaagggcagggctggccaaggcatccacagactctcctcccaggaggggaagatcagaggcaggacagggcaggagttcacagagattgtcctgggccctagggtatatagatgccagggcaggactggggtgcccacacctggcccccacagctctggctgtatgtgccggcaggaacttgctgctgcccgagggggtgcctgctgaacgccagtgggcccggttctacgtgaaaatttaccgagctgaggggctgccccgtatgaacaccagcctcatggccaatgtgaagaaggctttcattggtgagaacaaggacctggtcgacccctatgtgcaagtcttctttgctggccagaaggtattggggtgcaggatgcaggaggttgggtttggggtaacaagcagtagagctacagagtgattggaaagtgggggctggaggtggaggtgaggcaaaatcagaagccaggtgacatcgttgatccctgggtgcatttgaggagagtgggagatgaggggagctccagctgagaggggctggagctaggaccatgctggggaatcctttaagccatgggccttacgggatcctgcctgtctctgcatcctggagaccaagaactaagacgggagcactgaaagggaggaatctgagaggctggcgtgggggagagtgcctgctggatataagtgcacacatgcgttcatatacacccacatacacacgtcccacatgtgagcactgggtgttagatgcaactgatgaatcaccaacctctacctctgaaactagtaatacgctgtgtaacacccagtgctcattgcatcccgtgccctccttaatgcccatcgcccagctacatctccccacccctcccctccagcaaccctcagtttgtttcctatgattaagagtctctaaaaaaataaaaagagtctcttatggtttgtctccctctctgatttcgtcttgttttatttttcccctccttcccttatgatcctctattttgtttctttaattccacatatgaatgagatcatatggtaattgtctttctctgacttatttcacttagcacaataccctctagttccatccatgtcattgtaaatggcaagatttctttttccattatgtgtatacacacacacacacacacacacatacatacaccacatcttctttatccattcatctgttgatggacattgggtctttttccatggtttggatattgtggctattactgctacaaacattgaggtgcaggtgccccctaaattgaatttaaataaaaaatttgaatacatatatatatatacaccacacacatacacatacacacgtgactacacacatatacacataccacatgcacacacccataggtacacatgcatacacacttcctacacatatatatatgcatacattcgtagtccacatacgtagcacaacacatacacacacaacccacatgcatacacacatgtgcgcataagccaccacacatacacgtacacatgcacttgcacatacatgcatggatacacatgcacatacacacaccacacacatgtacatgtgcaggtgctcacacacacacacacacacacaaacacacacaccctaaccctcattccctcccaccagggcaagacttcagtgcagaaaagtagctacgagcccctctggaatgagcaggtcatctttacagacctgttccccccactctgcaagcgcatgaaggtgcagatccgagactcagacaaggtcaacgatgtggccatcggcacccacttcattgacctgcgcaagatttccaatgacggagacaaaggttagcaacaggagactgcattaggggcaaggggaccgaagggaaggggtaaatgggactcccccctcaccacacctccaccatctccacctcctccagaaaggcaccggacatagtgaggcttggtcagcagcccccacctcaaagggtggacagtcatggctcaggtctgcacagggttgacagggcctacctgaaccaggttgcctgggtttgaacccgcacagttagtggctgtgtgatctttgaatttgttttctcatctgtgaaatggaaataataattatgtgtgtttcacatatatggatactgctgccacagtccctatctatgggcttgtggggctcaccccttctaggacccaggcaccaggtaccagagcaagagaagaatccattcctgtcctcatggtgctcactggggactagaaaggtggatgtgctaccgaatgttcgaaacctaaggccaaagacgcagaaggccacatattacatgactccatttctatgaaatgtccagaacggtcaaatccatggagagagaatatagactagtgattccaggaggcaggagagggacccggactaactaccagtaggtacagggtttctcatgagggggatggaagtgtcctggaaacaggtgatgctcgtacaacatactgaatatactaaaaaccaccaaaatgcatgttttaaaatggtgaattttatattatgtgaagtatatcttgatttttttaaatgccatgatttttttctaaaccaagcagaacaaaagccaaacaaacaaagctcatacagcagatcagccccatgttacccagagacaaattccaacagcaggagaagttaccggggcctaggaactgggccggcttcgtggagaaagcattacacaggcggacagagggaggatgtttggagaggaggggaggggtccacgtgagcagggtggaagacctggtgagatgcgggtctgcaccggccaccaggggccagaaggccaggctggggagtgtgagaggagctggcgtctgtaggcagccccggctccagctcccaggaagcagggagcctgacccaaggaagggctctgtgcgagtgaggaggctgcccaggccgcccatgcacggcaggggtgagctcttcctagggcctcctgtcagcctgcctccagtgattcaccgagcaagacacggggtcctcggctcggcagccaggaggtgcaagcccgacaccctaaaagaggctccaccagccccatgagcccgtcgtccctctccccgtggcccacaggcttcctgcccacgctgggcccggcctgggtgaacatgtacggctccacccgcaactacacgctgctggacgagcaccaggacctgaatgagggcctgggcgagggcgtgtcgttccgcgcccgcctcatgctgggcctggctgtggagatcctggacacctccaaccccgagctcaccagctccacggaggtacaggtggagcaggccacgcccgtctcggaggtgaggacccagggggcgggctgtcctccagggcccctggctcagccctcttccctccacgggaccctaggcctgggctcggcctgttgctgccgtctgcctcagagggcaagaccccatgacaaagcctccttccccaggaagcaggatcccacactctgcccccaataccccgaggggacctccattccctcccactgcctgtgccggcactctgcctggaggtcccaggtctctgctctgttcctgaccatggttgtccttgtctagggatatgcaggccggaggtcaaaggatttaggccttcagggtctgggctgcttagctgcccagcgggatgggatgtctgcccccatctgtctgtaagccagtaggaggaggcctggctccaggcctgacatccctgctgaggtttggggatggtttgaaccaccttccccacagagctgcacaggaaaaatggaagaattctttctatttggagccttcctagaggcctcaatgatcgaccggaaaaacggagacaagccaatcacctttgaggtcaccataggtgagtgccaggctcagagggatcttcaggcctgggggctgctcggtggtaacagctaggaagggaagctttgaccaatttccttcacgtgtcctcaaacacccacacagcacacagtgttcacacgactgtgcacacgtgcccacagggtgccttagctccacagggtaaagctgtgtttgggacatgggggagaaagcagccttccctgcagcagggaagggggagagagtaggaatccaggccatgtcctaggctggcccttgagtccagtggtcatcagggctcctagccaggtcattgctgggggtgggggacacagacaccttcctctggccagtgttctgttgtgtccaagctggctcaaactcctggcaccttccccaccccctgccttcccacttccctcccacaaacacaaagcagcacccaaatcagagggcaggagtatgggggtaggagagaaggattctaggccctctagtgccccattctgcctccaggtaactatgggaatgaagttgatggcctgtcgaggccccagcgggctcggcttcggaaggagcctggggacgaagaagaggtcgatctgatccagaactcaagtgatgatgaagctgatgaaggtggggacctggcctccgtgtcctccacccctcccatgcggccccagatcacagacaggtgagtcaggaggatggagggtcctgagaggccctacctactgcctcccatcgtctcatggcctggacctcccacctcccacctccctgggttccggccctcaacctcccacctcctccccctcaggaactacttccatctaccctacctggagcgcaagccctgcatctacatgaagagctggtggcccgaccagcgccgccgcctctacaatgccaacattatggatcgcattgcagacaagctggtcagggccaggcggggggagggagggagcaggggaaggcaggggtggggggtgcttcagagggccttgcccagcctggaagcctcccctgcaacacacaaggcagtctgcccagcaggaaaagccccagcgttacctctggtcctgtccctgctctcatgccccaggagtgggtggagggcccaagggctacatagaatggagtctgggaatcctggtccatcccatcctggtgttccctggaggaggctggcaacccctctgtctctggcctgcaccgcacccccatccaccatctagtcctgacctctgcccggccccagcgaatccactggaaccacagacccgtagcccagaggtggcttcttccttcaggcagagacagagcctggggcactggtagtttctgtatgatgtcaagacctgggcagggtggggcatggaactagtgaggggtcccctgatgaatggggggagacttctggggagactgaggcagggggctgtgggtcagcatgcaccctcactcctggtctgcaggaagaaggcctgaatgacgtgcaggagatgatcaagactgagaagtcttaccctgagcgtcgcctccggggtgtcctggaggagctcagctgtggctgctagtgagaggaaggggtcggggggcgaaggactggaagtggggggctgagcaagggaggaagtgtctgcaggcttgctggccggtggcctccgctgagcactactcccttgatcccccagccgcttcctctccctcgccgacaaggaccagggccactcatcccgcaccaggctggaccgggagcgcctcaagtcctgcatgcgggagctggtgagaacatgctggaccacacaggggatcaagggagggtgcccaaggccaagggaacagctgtctctaaggtcacagccaccagggccagctcccttcgtcatgcagtgtggcctgagcccctcaccaccccaaccctccaacccccgcaggaaagcatgggacagcaggccaagaccctgcgggctcaggtgaagaagcacacggtgcgggacaagctgaggctatgccagaatttcctgcagaagctgcgcttcctggcagatgaggtgcgccccctgttatcgtgcagagagggggtgcccagccctcaaaccagagtgactggagtggggaggtggttgctgcacaggaagaggctggacgggaccacctaggaggcccctctggttctgacagcctttgggggacagaggagaacaagccattcatcctgtcctgtgttcttcccatgcaatttgtgggaggtgaagaagacccagctttggggtcctcccctctgcaggcccaggcctggccctctgggcccagagggtcagtcaggctctggggccctagccccatggaggacccctcccttagcagccccctcttgcctgcccccagccccagcacagcatccccgatgtcttcatctggatgatgagcaataacaagcgcattgcctacgcccgggtgccctccaaggacctgctcttctccatcgttgaggaggagctgggaaaggactgcgccaaggtcaagacgctcttcctcaaggtacaaaaggggaacgagtcttgggaatgaggttggggcccaagcttggcatctggcttcttccaagggatcagcctcctcttggagggagtgccctcccccccatagcagctgctcacagcagagctggagagagaataggaaggggggacgagggccagatagcactgtcctgcccatccccctccgttctgttcccaccatggtgaggtggctgtggagggacaagggcagctctgaatgaggcctttgccagggccccccacttgtccctcaccccctggacccaacagctgaccacaacccctcccccagctgccaggcaagcggggcttcggctcagcaggctggacggtgcaggccaagctggagctctacctgtggctgggcctcagcaagcagcgcaaggacttcctgtgcgggctgccctgtggcttcgaggaggtcaaggcagcccagggcctgggcctgcactccttcccacccatcagcctggtctacaccagtgagtgaggccccctcatccaggccgggcctggctgccagccccgggacatgtgccagcaaatcctgctgtcatcagccttcccacacccccgggtcccccagccccctgcccacacctgctgcagcgcagtccgggagggcgccagaggggctgcccagatgtatgtacacggagcctcagcttgttcttccccacagagaagcaggccttccagctccgagcccacatgtaccaggctcgcagcctctttgctgctgacagcagtggcctctcagaccccttcgcccgcgtcttcttcatcaaccagagtcagtgcacagaggtgagggctcaggggagaagggaggggctctggctcggggagtactgggaagcccttgagggtgtgggacccagaaaacagatcggccagcaccccagatccttagagaacagccttgcaggtatctgtgggcccagaacatactggtaaaggctttaaattgtgattacgtttgacacagaagaaaggaaaggaaagacatggtggggtgggggggcttgggagccagcctcatgtaggccttcattttaagcttttgggaagagtcagggaacatgaccctcctgtccccggagtccctggaagtcacagtgatttgggtgactcctgctcatgtacgtgcccacacgccaccacctattacccatatcccccctgtcccacgctgcaggtgctgaatgagaccctgtgccccacctgggaccagatgctggtatttgacaacctggagctttatggtgaagcccatgagttgagggatgatccccctatcattgtcatcgagatctatgaccaggacgccatggtatggacaggctcaggcccagggatctatgccttcatctctgcattccacctgccttgagagccacctccccagcacagccccagggctcctcagccagggtgcttgctgggaagctgggagtgggggtgggggctgctgaccagaccctccagcagaccttcctcctcctgccctgttactgcagcctgaccccttcccgatcctgggggcctctgggatctcaggaaacagctaggccagagtgtccacacatcctgccacagataggcccagctcaggcccagagtcatcaggacatgtgccagcaagtcctgctgtcatcagccttcccacacccccgggtcccccaaccccctgcccacacctgctgcagtcagtaacagcttcacagctctccatggaaactctggagtagagaagcaaaggattgagatgacccttccagagctggggggccgcccctccagctactgggatactctgagagctctggactagacgtaggaagatttcattgctagtcctgagtcctgcatctgccattcactgccagcatggccttgagcaggtctgtgatgggccccaaggcttggtcttccccatctgtaggatgaggtgatcacacctgccccttagctcctgaggctgtggtgaggactgaacgagatcccaggtgtgaagaatatccatagtaaactcaagcgctgggaggccacctgggttatttgtcatgtcagggcaaagccgacttcatgggccggacctttgccaagcccctggtgaagatggccgacgaggcgtactgcccaccccgcttcccaccccagctcgagtactaccaaatctacagaggcaatgccacggctggggatctgctggctgccttcgagctgctgcaggtggggccacagggaagggcactggggccgggagctgccctccccatcctgccgtgaggccagtttcaccaaaactgtggtgctgcagtgtggttctcggggacctggggcattagccttccctggctccccatagcacctgacaaatacctcatggggaaggagagtgtgacactatgactcccatcccccagattgggccagcagggaaggcagacctgccacccatcaacggccctgtggacatggaccgaggtcccatcatgcccgtgcctgtgggcatccggcccgtgctcagcaaataccgaatcgaggtgcgtgagggctcagtggggatcctccggtccctgccctggacaggccctgctgcgttctggcttcctcgccccttcactctcctcccatcaaggctcacgtcacacactccactgcgggcatcaggaggtctccagcaacctcagacactcctcatttttcagacaaggagactgaaggcctcgggagggaagtgacgtgtccaagtcacacccaggctcctacccttgcagtgcctgactgttctgccccaagtccagaaccttccccagccctcctgtcagtgtccccatgcccacccgaagccccgaagccccttgaggacactggcctctcatcggttcccctggccctgcctctcctaactcactgcccaccctcaatgggccccactgactgaggggctctcctctcccccccgccccaggtgctcttctggggcctgagagacctgaagcgggtgaacctggcccaggtggaccggccgcgggtggacatcgagtgtgcaggaaagggagtgcagtcgtccctgatccacaattacaagaagaaccccaacttcaacaccctcgtcaagtggtttgaagtggtgggtgcaggccccgggcagagccagacagaactgggtgtagcttgtatggccggggtgggtgtctcctctgttccctccttgatcccaggatgcacttggtcaacaccccaggacctcccagaaaacgagctgttgcacccgcccctgaacatccgagtggtggactgccgggccttcggccgctacaccctggtgggctcccatgccgtcagcgctctgcggcgattcatctacaggcccccagaccgctcagcccccaactggaacaccacaggtatggccacaccccgaagcccaggcctggctccatcggcccacaggagcagctcctgcccacagtccaggcctcgaggccgccagctggctacccaggggcctccctgagtgggcatgagggaggccaggggacgccccatcctgggggccaagctacctttggctgcccatcactctggagcagaaagagccagagccagacacgttcttcaagggccggagggcagatggcttcctctgctgctctatggatgaggccaggcctcccttctagcctccctcccggcccagactctactgtttgactccacagcagctcagccttctctctggctcattttctccctctccttatgcctatcttttctctctcaactgccctgtccctccctcttccctcagaaagctccaggatcagctttaggcccctggtccttctgaccacctctgattctcactctcattcttgttcttccctgtctgtctgcttgtctgtccgtctctctgtacagtcaggctcctccggggtggccgtgtgctgtgcaatgggggcccctcctctcaccccacaggggaagtcgtggtgaacatggagccagaggtgcctgtcaagaagctggagaccatggtgaagctggacgcggtaaggcgcgtaacgtcagccccacgctagctgggcacctgtgacgcttcgcaggagcagggccgcctcctttggcatgtcatggtcgagggctaagcctgcctacatctgcaagcagtccatcctagctctgttgcacccgcccctgagtgcaagactgtcagttctgcatgttctttccagagactgcctggtttttcatcccagcaattcacaaacaagcctccctaggcccgggctggggagagatttctgggtggaagctccttatgcctcttggtttggacactagggccatttatctgccagagagacacctgtcatctgggatttagatgcagagctggtgtctgcagggcagggtgggccagatgtgggcttcctccctgccacattctctccactccactcctgacctcaagtcttttacacagctggggcacctcccagcttctgaggtctgaactcagtctgaaatgaccttcccttggctcacagtccttgaccccggagggtcccgggcagttggctgagttagcagggggcatgggtctgaggaaaggggagcagatgagggacggggctggttcacagccctaccatggcactgccaggaaagcccactgctgcagggctatgcctggagatgccaggccccctcagctcccagcatcctgaacttctccctgtgggctcctcctgaggccaggggagagccccctaacttcagaccatcggtgaaaaagatagaggacagcatgaacctgagcttccccctcatcaccccggccctggactctggtggggatgttttcaccagggtcctcttcagctatgcagttatctgtgcatccattgaagttttcaggctcttgccctagtaaggggggacagtagagtggcagttgaccttgtctagctagcattaatgagttcctgctgcatacgggtcagcttccctgtccaaccctgaatgcccattgaaaacatctgggaagttttcagccatgcaggtgcctggcccccacattcagactcaggagagacctggaactgatcatttgtaaccaccacccccgccccccgccgtgagtctatcacgcagtcagggtggagaaccaccaccctcaaagggctgttgtggggggacgcctgggtggctcagcggtttagtgcctgcctttagcccagggtatgatcctggagacctgggatcgagtcccacatcgggctccctgcatggagcctgcttctccctctgcctgtgtctctgcctctctttctctctatatttctcatgaataaataaataaaaatattttaaaaagaaaaaaaaaaaaaagaagggctgtggggaaacatctatgaagcagacctcttgcaggttcaccaggcagtgtgctcttgtcagcgctaagtccacagagcacaggggctcccacagtgaacatcaccgcatgaactccctctctgctctcgctttatcctctcctcttctctctttcccctcgtctcctctcctctcctctcctggctgggtggctgcctaccacttcaggcccctggtggctaattctgtccccatctctttggttcccctccacagacttctgatgctgtcatcaaggtggatgtggtgagtgtggggccatctgggggctttgggctttgcagtggcagaggatatcaaaccaagaggccctgcatcagggactgagccactccccaggccctggatgctcggggtcagtaccttcctccaaagaggcagagggagagaaccattcaggcagcaaagccctcgagagacagttgtgttctggccagcagctcaaactggcaagtcatgaccctctctgggcttggtaccttcctccacaaaacagggccctttgacactggtgacctcaaggagcctcatggagtctagggcttcccagaagtaaatagttaaaatagatggggaacccttggatggccagggctcagagaatgtccagggagcagggctgtatgcaggactctggacctggccaaccctccaggctgacgaggagaaggagaagaaaaagaagaagaagggcaacgcagaagagccagaggaagaggagccagatgagagcatgctggactggtggtccaagtactttgcttccatcgataccatgaaggaggtgaggccttgggcttgggctggggagctgagaaggaatagggctgggggagttgaccccaactccacatcggcccctctttcccattccccaccagagccagttcccccactccattaacatgagctgggaacagacttgtctcacatccttgaagttccagctcaggacccaccttttccgagatggcggtccagtctaccttctctgcctaggctttctctgtcttcactcatcttcactcacttcactcacaccacaaacacctcctgagtatatgtgatgagtcagacaccatcctaggtactgtggaggccaaagataagtccataacctgccctaaggagccctcatggacatgtcagctgacatagtgtgatgacaaaggcagatcaatgcctgggggagtcagagaaggcttcacagggaaggtgacctttgaggaagaggagaaacacgtgcagaggccaaaagggagcaatgatttcttagtaggacttgcacctctttatattgctttgttctacatatctcagccatcgtggctatggaatgttcttcccctactggatgcatgcagcttcttcttcctgaggctgatcgcacattccagaaactgcatttctcttcttccacctctgactctctccacccagatcagggcattccctgccttaccgactgaccaggaggggcttgtgcctcagtaggacctgagctgatccagacaccctctttccccaggtcctttctgtgacccaggctatgtgtgatgtttactttccacattaggttagccggctaagctgctgtagcaagttagagtagtgtgaacaagaccgaaacttctttctttctcacatgtctcagagagtggtgttaggctgatagggggacataatggcggcaagccccaagaccctgccgcttgttgctggcatctgtgtggttagaggtggctcagcctcaggtcctaataccagagcacaggaaggggtaaaatagaagaagaggaagcgtactccttccctcttgagggcccaacctggaggttgcacataccatttccactcatgttggccagaatctagactccatatctacacttagctgcaaaggaggctgagaaatgtaatctttagctacatgcctgtgtgtccagaaaagcttctaaagagcaggaggttgccttgagggtgggggggttccctagtcgtaccttctcccaccatcatctcctggattcaagctgcccaggctggagctccaaggggctgcctattgtctcatctctactcctgtaatttgcacaggttgccaccaagtggcgccttaatggaaaccccgaggtttggtttccagcaggtagggtggactgtggggaaagaacattaaaacacattttctgattccgttatacttgtctacatttaaaaaagtataataccactaagaatcaacattaaaaggcattttatttttaaatgatatacaatttaaagaatcataagctcctgagtagttaggcatatcgtacacatcataaactttttttaacccactttacatagagcacatgatgagtttgaaccccaatcagaaagtgtttctgtttcctttttttttttttttaaagattttatttgttcatttgagagagagagagagcatgagccaggggtgaagggggcatagggggaggggcagagggagaaggagaagcagaatccatactaagccgggagccctatgcagcacttgatcccaggaccccggggccatgacctaagtcaagggcagacgcttaaccaactgagccacacaggtgtcccaaaagagtttgtttctaagtccttaagactagtctcagaccgcagtgtggggtcaaaagacccctccccaagaagcccaccttcccttcccttcacctcatcttttggcagcaacttcggcagcaagaggtctcaggcactgacttggaggagaaagaggaggtggacaacaccgagggtgagcctgggacctgggtctctgcctcccctccttccccagagggctggctctcctgcccaccacgccactatcatcagtagccgcggcagctgcaggcagctatcaccagccatctctgggcaccaagagcgggcgtagggcctcaactagggtggcttgtgcttgaaccagttcagcagccacagacatttagagccacggaacatcagagctggaagggagctcagagctccagcatcttccagaccctttccatggaacactgatgataatgggtcttccaaggggaaaagaggattctttggtcaaatggattaaaccggtctttaggcacaggacttcccagtcctttaatatacaaacgtgatgataagtctctaaatggaagttacaatgtaaaagatttcccagcttatctgaccacaatgtacccttgctcctaaaacattccaagaacatctacagctggtgtcccactgaacgtagtttgggaaatgctgatatggaacagccctcttaatgtgacagacaagtagactgaggccagagaggagagtgagctgcacggtgctgactcaagacccatgttccttctgtgctctaccctgccagagggcgtgacagcagtcttcatacactgtcccagtgtggctttattggtgccctgcccccgtgtgaggcaggcatgccagggagcactgtctgcagcttacaaatgagcacacagagccctgagaaattaaattaacaaagtaaattagcagcggatctggctctccaaccccaaacttcctgctccatcacttctgccccaaactgacctgggcctccttttctggttctggccaggcctgaagggaccgatgaaggtcaaggagaaggcaaaggcagcaaaggaagagaagaaaaagagaacccagggccccggcgccggccaggggtctgaagtccctgagaagaagaaacccaagattgatgagctgaaggtgagggtctgggaacagaccgaccaggagcgtggggtcatgcctggggcaggaagtggcaggtggggtgagatggaggccagtggtcatggcctgtccccccgacggcccggccctgctcaggtgtactccaaggagctggagtccgagttcgacaactttgaggactggctgcacactttcaacctgctgcggggcaagacgggagatgatgaggacggctccactgaggaggagcgcatcgtgggcaggttcaaggtcaggcgaaggccctgaaccctgagcctccctcccaccagctcttctccccaccccaagccccaagccccaagcccagggctgacagtcaagtggagctgttagctatactgattagcaaaatacgaaaatatttctgtgctgattataaaagagcatctgccctgagtgtcccacctccaacattgccctggccactccctccagaacccccagacctccctctgacgcaagtggctgaagggttaggaccctgagcagcagggtgctgttttgaatgcacccctgccatgcctatgggaactgaactgcaccctgactgccttgccttgccccagggctccctctgcgtgtacaaagtgccactcccagaggatgtgtcccgggaagccggctacgaccccacctatggcatgttccagggcattcccagtaatgaccccatcaatgtgctggtccgagtctatgtggtcagggtaagactcccccctcagatctctccccacagtctcccaggccccttatgcaggaggagctaaagcagtggcaaagtgacagccccaactgagagacaccaggaaggtcatctgatctagttcccacctttttcttttttaagattttatttatttatttgagagagagagaaggaaagggagagagcatgagtagaggggggagcagagggggaaggagaagcaggcttccctccagagcagggagacccatgcggggctcaaggccgggaccctgggatcatgacctgggccgtagccagcggcttaacccactgagccacccaggcgcctcagttcccaccttttatagaggaggaagccaagacctgagacaggcagtgtgacttgcccagggtcccgcagcaagtctcccgtctctggttcagcgctcccaccctttgccatcatgggaccatcagggagggcgcgagggcactggaaggtgagctgggtgtgtggggagcctgctcaggagcacctgcccccatcccaggccacggacctgcaccccgcagacatcaacggcaaagcagacccctacatcgccatccggctgggcaagacagacatccgggacaaggagaactacatctctaagcagctcaaccctgtctttgggaagtaagaccccctggcgtcccacatgccgcccctcctgcccaccccgcttccccagccggccctccacccaccccacccagccccgcccttccgccttcctgaccccacccctaccccgccaggtcctttgacattgaggcctccttccccatggaatccatgctgacggtggccgtgtacgactgggacctggtcggcaccgacgacctcattggggaaaccaagattgacctggaaaaccgcttctacagcaagcaccgcgccacctgcggcatcgcccagacctactccatgtgcgtggggcggagcggagacgggggcggggcgagggcggggagggagcggggtggggcggagacgggggcggagacgggggcggaggtgaggcggggcgagggcagggatggggcggggcggggacaggggtggggcggggcggagacggggcggggcggggcggagacggggcggggcggaggcggggcggagatggagggggcaggagggggtgggtnnnnnnnnnngaatattaaacacttctgatattcacaaaggtctcaaatcacaaattactctgtaggataatatgcaagttcgttactatcaaatgactttccaaatctaagatacggaacaaacaaaggcggggcaaaacggagacggggcggggcggaggcggggcggagatggagggggcaggagggggtgggtgggatggggaggacgggggcgggcggggcggagcgggcacgagggggcgggccgaggacggagatgggcggggcgagggcggggcacgactggggcggggccggaggtggggccgggccgggcctgggcgcttctgcagtgtcttgtctctgaaaacaagattcagggattgtgatttgggaaggtggctctattatggtttctgccccaggccaggcctccttccatgggttgtaagacgaggcgagagccagaggattccgggccagaggaggcagggcaaggagagaacagtgggctgggaggagaggtggcgctgctatgcaaaatccactggggacctggccagcctctgcactgacaggctgtgtgaatctggtcacatccctaacctctctcgttatcagtgtcttcatggaagtctttgaagtaccggaggaaagggcatagttgggaatgggctgggctgcattgggggacgctgaaagctcatccttgagacactgggcatatgaggctggggcctggggtaggagggagcagcccccagcaaccctatctcaggtggggcccacatgctgactcaaggcagcagccaatttaagggaactggttggaaccagttaccgcctggggatgggcccagccccaccctgagcccgacgaagcctgtgtgcccctcccacagacatggctacaatatctggcgggaccccatgaagcccagccagattctgacccgtctctgcaaggagggcaaagtggatggcccccactttgggccccccgggagagtgaaagtgtccaaccgcgtcttcactgggccctccgagatcgaggacgagaatggtaatagggcactggacacagccacggggcctcagaggccaagaggaacccacacatccctggaggaggatcttgaggtctagactggagtctctttagaccctctgcccatcagcctagagtcccattcctgtctgcccagcctctgcccttccaccccatcctacagggcacctgcccacttgttgtcttctttctccatctcagaattcctgtggggtaggatggttctccccattctgcagagaaagagaaagacactgagacccaaagtgtttcagtgacttgcccaaggtcacatggcttttcagaggcagaatgagaggtgggcccagatccctctgactccaagccctgggctctcaccactcctttgcccacatggcacttcccagagaatagagaggcatgtgtgctgtggaacccttgctggccaccttcaggatgctgggccaagaggtggattcttgccgtcctcgccctcacagcctagcaggattctctagtcaggtttcccaggcagagcaaacccaaaaacccagtctctctgggccctgtggggcagctgagaacttgggcaagccaactgtccccctgtgcctcagtttccccaatagtaaaaaggagatggggtggacaggtgatggctcaggggcctctttgtgcccctgagtctagcccagcacaggtttcttattctgctgaggctgtgtgtgcaactgacccaccggcacccgcaggtcagaggaagcccacagaagagcacgtggcactgtctgccctaaggcactgggaggacatcccccgtgtgggctgccgcctcgtgcctgaacatgtggagactcggccgctgctcaaccctgacaagccaggcatcgagcaggtgacacttacctggcttagatctgaggttctttggtatctgggatcagggtgtccccacctgagcccataaaaatggatcctcatactgtttgccacatccccaaaagcctggcaggcacttccccaccatggcccttcgcagcaactctggtggcatgcgtctttgctctaagtgagagtcacatcagctcaggtgcagccctcaggggtctcccttagaagctgtgattggctattggtgatgtcataggaactctggcatccaaggatgaaaattgatgaactgggtcctgagggaacaaaggttggtggggggtagctggcattccggggcagggggagtccactgggagacctgccatgccccctcttccgcagggccgcctggagctgtgggtggatatgttccccatggacatgccagcacccggcacaccactggacatctcccctcggaagcccaagaagtgagcttctggggcccagcaccattgccttcccctccctacccctcccacctctccatgaccttccttcctgtaggggccccagactcagatcacccacatcgccgtggtcagtggtgcttcccctgtggccttgtggggggaacatagcaacccatggagagagcagtgggggctgccctgggtgggtccccttttccgaggcggagccacacccccagtgtgccctgggtgaggcgtgaggagatgtgcactcatcagcaccgcccagtggactttcatcctcccagcggcactaccccggagcctgctctgttggccccactccaggctgtcattaactctgccaggttttatttaaaacccctgtggaggagataggcaggagtgagtgcccagaaaggggttggggaggcggggggtagagtggaaagaggaccagaggcaaacagcctgcctctcccacttggccctggccaggtcacacggcctcccgggtcctcggctttcccatctgtaaagtggcagaatggcgttgctgccagttctgacacctgcggtgcctggaaccagggcctggatagggaagtgccacaggtcccacactcagagcggccccatgtttatttcaagatgacaatatctaaattcttaatttttaaaaagattttatttatttactcaatagaggtcgtgagcacacaagcagggggaggggcagagggagagggagaagcagactccccactgagcagggagccctatgtggggcttgatctcagggtcctgggatcatgacctgagccgaaagcagaggcttaactgactgagccacccagtgcccctaaattcttaatttttaaataaggggtcccacatttccattttgtactgggtcctgcaaattagcaaattctgcctggaattgcctccaggtctgtcatgagtgtgctgtcccagggctggccactagtggacacttcaccccatggtgtaatcggggactcagggtaaacttgggaatgccatggaccacatgccaagtaacgtgggggggaggtgactcaaccacactccgaatggttgaaatgtaaccaccgatttataataacaagtacacttcaagtggaaaaatcctcttcaaggacaaagacataaaggaaaccagattccttgggagtccactgccagctgctgggcttaaatacacatttgtgttagaactggagtgccttctggcctctggagaccgagattgagctcagccaccccccaatagcggccctgcccctccggagctgggtcagcctccctgtctaggggtgtgctctgggtcctggcgtgtcagccagacaggcttcccctgggccctcctgtctccctcgcccagggccccaacatccccctgttccctcagctccccctccttgcccccttccctgaatcgtctctctccaccccaatctgggccaggacctcatgctcaccttgagtccccaggactccccttggtgacctgccctatatatgcccaagaccctgggacagcccctacccccagattgtgagccagcctctcccctgcccaggtacgagctccgggtcatcgtgtggaacacggacgaggtggtcctggaggacgatgacttctttactggggagaagtccagcgacatttttgtgcgggggtgggtgagggcccctgacagggttggggggccctgggctgggagagcccacctttctgggggcaggagaagagggaaggggccccctgcaggtggccacaggtctggagctgatggcccctggcaggtggctgaagggccagcaggaggacaagcaggacacggatgtccactatcactccctcaccggcgagggcaacttcaactggcgctacctgttccccttcgactatctggccgccgaggaaaagattgtcatctccaagaaggagtccatgttctcctgggacgagacggagtacaagatccccgcgcggctcaccttgcagatctgggacgccgaccacttctccgcggacgatttcctgggtgcagggctggggaacggagggggcgggcagggggagcccaccctgggggcgggggatccaccgggcccggcctgtcagagctgactccagggctgccacaggggccatcgagctggacctgaaccggttcccccggggcgcgaagacagccaagcagtgcaccatggagatggccacgggggaggtggacgtgcccctggtttccatcttcaagcagaagcgcgtcaaaggctggtggccgctcctggcccgcgatgagaatgatgagttcgagctcacggtggggaccgccactgcttgggcagagggcaggcctgggcccggctagggcgcggagggtcccggcgcctggcctgagcgccgagatccttctgttctttctgcagggcaaggtggaggcagagttgcatctcctgacagccgaggaggcagagaagaaccccgtgggcctggcccgcaatgaacctgaccccctagagaaacccaagtgagtgtgctgccggcctggcccccctgccacgctgatccctggggccactggaacaggaaggggcagcaagaaccttctggacttctcgctcccgctctgcaagcacctctgtgttctctatctctctctgggtgggggagcctcttcccctgtctgctccccaccggaatccacccctccctctgaaccaaagcacgggctactttttcaggaaagcagcccctctcccagggaaggcccgtgtcacagagctgaatgcttttcctagttttagcccacaccgctgcggtggtggaatgtggggccccaggcagccctgagggccggggaggtgaccagaggtgcacacgctcagcccaaggtcgccccaacccgttgcgaggcccctgccatatcctgagccttcttcatcctctgtgtcctttctccacgctgcctctgccctcttgctgctctaggcggccagacacgagcttcatctggttcttgaaccctctcaagtctgcccgctacttcttgtggcacacataccgctggctgctcctcaaactgctgctgctcatgctgctgctcctcctcctcgccctcttcctctactctgtgcccggctacctggtcaagaagatcctgggggcctgagcctggcttcctcctggctctggtactcctcacttcttcctctggacctagggctgatgagctgggcagcatgtggcacacacacacgtgcacacgggatgccccccccccccacacacacacgtgtacacgtgcacacacggcaattttcaaacaaagcaacctgcctaaggtcacctagctgattagagctaagacccagcctaggttttcaagttgccaacccaggatccttggcttgacgctacttgctgtccttgtgacaggctgactctaacccagtgctgttggcagaaagcagttgacatgtggacaggggatggggaagggtttggctgggagtagccagcaagacctcactggttcccaccagcccccatctcccaacccagagccgttttctgtcgtgcaggccagtaaggaaccctgtccagttcccatagcttagcggccaacatctgctgaccaggcaatatctgctgagcagctgggggcctagcagagcatgtgcactttgtctccttcccctttaccaaccccagaggcagagtccactattaaccccactgtgtaagtacagaaactgaggctcaaacgggagcctgacttgctcatcaccaccaggcctggaaaccaggtgccctgagtgggagccccactgtgccctgagcctggctctggagggcatggtctgtgtcctctgcggggccagtgggacaggagcttgaaaaaaaatctattcagtacttgaattttatatcttgacatcttataaaacctactgtctttgtaaacatgaacaccagaggggattgcttagcaagcacctcttggccggaaggctgtgcagaagatagagcagcaaggggcgtgcatcccacggaggctcctcagaccctgggcagggtgcggtgggcatagatgctcatgttcatcacagagggggagaggctgagagacactggtttcacagagacaacacggggcggccccagagcacccacggggagctgctgaacagaggagcttcccagggatcagcactgtgggcagtgcggcggctgcctctcagtagtgaacagccacggccaccagtgtccaggtggaggctggacggctgcccagctgccagaaagccctctagggccttgggaggagaccaagggtgccagagggtcccacaaagagcctaaacctggtgcttaagaaaggggtccacacccggttccagcactctcactacttttggaacccaggctgtgacagggcatgttgggggtcttgaagagccgagggcatggggtgccctgggagaggcccattgcctgaccgcatcccctccccacccccagccggcctgacaccgcctttgtctggttcctcaaccccctcaagtccatcaagtacctcatctgcacgcgatacaagtggctcatcatcaagatcgtgctggcgctgctggggctgcttatgcttgccctcttcctctacagcctccccggctacatggtcaagaagctcctcggggcctgaagccccacggcctggctgccgctcctctcctgggcctgggcctttgtccctcctctcgtgtggactttccagtctccctggggagcctgggaagcccagtgtccacccttgtggcctcaagtcccggaagcctgcctcctgcttgctgggctggcgaccccatccctctcctcctccaccccaagcctgttgctggccctgtcccactcagctggtccccgcctggtgggtgagaagggtgggcaggagtgggggtctgtcccttaagccaccccagatcctcccttaggttttcccgtggaggagtcaaggtttaatagaattaactgagaatcctgtcatgggccagtgcccagagctataaaaaaagaatgaataagcaaaaagcatcaccctccctcctcaacagaatcttgtgagggcagtcagaccaccagtccttattctgtaaatgagggccagatccttcctgctaaggcgtggaggtggccgcttctgccctgctgccctccagagtggctcctcctcctgcccaaggagccatcatggtgggtgcacaagcctcggccctgccctgcctgtgggtttttatcgcttcccagagcttcctctgcctggtccagtgctcagaagcttagatgaggagcagtgagagtgaaaaccctgtgcccacccgccctgccaggccctcatttgaggccaggccaggaggtggtacttgcagtgagagcctggtttctgttggctgttgttcctttcgtgagtggtgatttttctcttaataaaataaattaaacactgagctgacaagtctgcatttggccaagttgggggaccgtataggggcccagagtttgtgagctctctgaggttggcaaactcatcactagctggacccttctggctttcccctttgaatagcctcgtggcccaagattcaagaagggcctaaggcatggggccacttgctcaggctggccacgagaagagccttacactaaaccaggtggaaccggggaccccagaagcttaacaaaagggtcctgcaggcccaaggacagtctgaaggcttaagaccctacaggagcctagagcacttgggtggctcagttggttaagt

SEQ ID NO: 19 - DNA, 101696 bp, Pan paniscus
  source 1..101696: mol_type = genomic DNA
ctgcaggagcagcttagctcggcttggttgccttggtctctgtgggcagcatcggaggggggtcgggaggaggaggaggaggcagcggcagagaagagagaggcgtgtgagccgtgctccaccggctagctccttcccactgctcccgcctggcagtgccaggcagcccacaccagcatggccttgctcatccacctcaagacagtctcggagctgcggggcaggggcgaccggatcgccaaagtgactttccgaggtagggaagcccctgtctcagagggacgccagctctgagagctggaccagcccatgctctggaggtggccggggataggacagggctgggaggatgggtgggaaaagttctagcaggggctggggcgacgagccttttcacaggtagtcatctgcccgggactgactggccattgtgatttctggaaaatcagggtcccctgttcttccatgcctgtgtctccttgtgcttgccaacatgccagtgcccgggcagggcacagagccctctgcctggggaggcagaagtgaggaccacatccctgagctcagggagacccaggaccccctccttctctctctccctctcctgcaggttgatttccttgagcacagggtgggggctgggtatggagcctgggacacccagggtgactgggagaaaccaggcagccagtagctccctgggccccagagtgatgggggacactgttggcttcttttagatctattcatgggcgggaaccctgggagcccctcgcctctcttctatctggtcttttctcatccttttcactcctgtattcagcgaccatttatcatgatctactgtgtcccaaggataggggtagaaacacagagctgagcacaacccagccccagccccaaggagcctgcatctcttgggcaggcgtggaacaagcaggacaggtatgtgagacagaaggtgggggtgcagcatgcaagctacagaagcagcaccctcacccaggctggtgaccggtggtcagggaaggcttcccggaggaagcaacactcagctgatacccgaaggaccagcaggtgggagctaggagaggaggtaaggactgagcaggcagaggaaacagtgtgcccagagctgagagaggagctgaaactctggaactgaaagaggttccatgtgtctacagctcagagagggtgcaggagcggaggccagagagccaagcagggcaaggaggcgaggctggacctgaccccggggacagcggagcccctgagcattttaagtggggaaaggcagggccaggctgactctgtccttcaccacccacctctgcctctccatgtggttgctgcccagccctgagggttgggggtgcttctcactagacatggccccttctcccgagagaggggtctgagagtgggatggggacgaggtggtgagaagagggcagagaggacccccctatactaaagagcaaagtgagccttggggcccaggctggacacagtgtctgcacctctgttggaagggatgggagagaccattggcagaacattccagcaagagccctggggcacccacatcacctacccagaggccctgggatgcccacattgcagcttgtgttcatagggacaggcaggggtggaggtgatggcagtggccttgctggcaggcggaggtcaggcaggagggaaagggaggtgtgggctgggctgccttttgcctcccaccccaacccactgactgctttctctgcagcaccctggatctccctctgtgtgccacctgcaggctcatgctggctttagaaaaagcaaatgtgtcctttcatctgtgaaatgtggccctgagctccatgggcagcatagtgtggggcggttaagctacaggttgccatcctgctgcagctgtgctggaacggtccaggctgcaccggacaggcccacttgcaggccgagaaaccaaggttccggggtagaacactgtgcgtggcattcacggaggggctgaggcacggtggtcccagctctcaggacctcatcctgagtactcaatcttgcaagctctttatctgctcctgggccacctgggggccagcaccttgtctgacacccatcttctccttggagcagtgaagggctgggcctttagcctcactgaccacacaggaattagtttatttgcaacccttgctctctggactgagtggagaaatcgcttccaagctccacattggcaggaggtggccatgggcagagctcctggggaagggggctgggcagcaggaataggcagatgacaagcagtttccagaaagttcctttattacaacgaaagatgcctcagccgctcacctgtgtcatctagcagttgacagctgtaggcgccccaaaagaccaacactgaccacaattcagagagaatggacccgctctacaatgttccttagcatctcccagcacatgcaaccactgggggccaagcaggtcctctgcagggggaaacaagaaactggtaaacacgcagagggagacactggccccaggctccccaaggcttttgagtgaaagtcaatgccgggggaggtggtgagggagcccttgctgagctgtgcccattggcagtggccctacgtaggacagagcagctggttgaaatatggcttgaccttctgtgctgtgccatccaagaccctaaagaaagagccctgctggtctatcgtggaaaaagttctggatatggagtcagaagccctagatcctacctgggttctgccactcaccctcagtttcctcatctgtaaaatgggcatgataataacactcacttcactagattgcttcagggaaaccataggtatggaagagtttgagggaagagtattcaaatggccgatgtgtttgtgaggcagccattcccattctccttgggagcagctgctggcccctgaggtatcttctctccagaccagcagagggccccatgtgagatataaagggaagaggaaagcacgtctaaggggttccagtctgccaggagcaggcagagagcctggcctctgctctgtaggagcctctgctgagatgttccgcaggaacccaggcaggcagacccccgagactcctgttctcatctggctgggtgtgcaccagctttgcccgtggccacctcttttcccactgccctcaggtcagtcggcccctcgctcagtgctcccagccagttctgtatctagctcttagttcttactgcccctggctgctcctaagctggtgctgccctgttcatgcatttcctgaacatactgatatttgtgcacaggcctgggaccctgaggtgaaggggccagcctggccctccaggagtcacaatcccattgggtcagacaggagatagggagtcctgggtgaatctctattgtgcctgcaggccacagggctcagctgggtttctcattaacaaaatggagacagtggtcctcatttagctcagaggcctgcagttcccaggagtaatcaagagtgggctatctgagaaggagccatcttgaccacaggttgctactcaaagagaggaagtattagcttcaggtatttcctttatcaactcctgagatagttccctacatcaatcacagagccacagaacgcagggtgtgaagggtcccaaagttcttctagtccaaccttctgtccagtgctgagccccaaggctgggggacctggactgtaagggaaccaagtgacagactgtccagggccaaccctgatgtctcccttctctttctatcccctgagccttcttgccaagacatgaggtttggggattttctgtgtgagataagaacatctaaaggctggacctggcttccacataattcactgtggctggaaattggcacaaaggtttgcagggcatccccctccaccttttcattcttactcttcttcccaccctacccctgattcccaccctgctatgttcccactacattcaacttccagccattcccaaaagataccacacccttttacacctccaaactttgagacatcgatcatatttcttctgcctggaatgaccaccctccaccttgagaacgcccattaattctgctcatccttcaaggcccagctcatatgctacctcctccatgaaggagtagtactttgcacacaaagtactcctctagcagtactttgcacacattcttcctactgctctgccaaggtacattgcatttcagaaactggccacacctctgcatgctgcccaagcttttgagcatcttcaggatagacatcagacatggtttctgtctttgagggattcactgtgtcatgggtttgagttcttccactgtggcactgccactctttggctccatttccccaactgtgagctcccaccccagaactttctatccaaggaggatcgagggactggaagaggcctcaagggccaagaaccaagaaccttggctcttactccttccatcaacttccctagcccagagaatcttctagggctccagaggggcctaacaattttttttttttttttgagtctcactctgtcaccaggctggagtgcagtggtgcgatctcggctcactgcaacctccagctcctgggttcaagcgattcttctgcctcagcctctggagtagctgggactacaggcacatgccaccatgcctgactaatttttgtatttttagtagagacggtgtttcaccatatttcccaggctggtctcaaactcttgacctcatgatccgcctgcctcggcctcccaaagtgctgggattacaggtgtgagccactgcgcccagtcaagcctaacaaatattagcaagttcagctccagcccataggtgggaagcaagagggattgcatgtgtaagccagagtcaattaggggaagacagaggaaggagaaagggcagacgggaaaggaggtgggagcaggctctgaattggcccctggagcccagaagggaggcgggagtttttattgagcaggggaaatgggtggtatttaagaagccactgaaggatcgtagttcattggcaggatcaaaggccatgaaagggccaggcgtggtggctcatgcctctttccgagccttactgcgaccacacatggggcaggatctcaccatctgacagaggagaagaaacatacacacagaggtgaaaggagtgcagcatacaggagggccagcggtgggggtaaatcgcaacaatgttcagaggatgacagcttacttagagctacagagacgagggaaaaggagcaggaggaggaagtgcctaagctgggtctggaaaaactgcccctgtttgcacctatggagatgcaggaagtgaggaattggtgatggaggaaggtgaagtcattttgggtgagggactgaccagaccagaggccagaggaggagaattgcagccaagttccatgtcggggaagccacaccatgtagctggagcagaggctataggaagtagaagagggagaccagctaggaaaggagcaatgggcctgctgagtgattgtgcagggaagggttgcagctgaggcactggggacaagatgtccccctactgttggctgcaggcgcgacctctgactccacattagatttgttttccccagtaaaatgagggagccctccctcttgatgataaatatagctactatttggaaacttatctgccgcccctggtaaaggaggcagaatacccagtgcacccacccctgaaatgctcctgcaatgcctaggcctgtctgtgggctgtggtccagcctagcaccccctctcttggagaatgtgaggttggcattgtccctgctgaaggcagcaatagaggggacccttacaatgaccttggcagccggtggctggctgtggacacagccctgcgcttttgttttagtcctaacggatatgccccctgcatcctccattcttcacagcacactcagaccccctcaccacacctgagggaaatcttctctgcctaatgccccaggtagtgaatgttcacccctcctccctcccccagagcaagccattgcacaccagcgaacagcagacagagcacacagaaaattccccagacttctgctttgataggaagagtgtgttttcatgtaatggaaatgattgtaaaactgccttcccctgcaaaagccctcaggaatatgctgctggaaatgtgcttgagaacagacttgcaaatcatttctctgaattgggaagtcttggttatcttagccacttttaccgatcatgtgaaagccacatctctcgcacccactcccatccctgggtctcatttttttttttctgtcgcccacgctggagtgcagcggcacaatcatagttcactgcaacctcaacctcctgggttcaagcgatgctcccacctcagcctcccgagtagctgggactacaggcacgcaccaccatgctcagctaatttttgtatttttagtagagatggagtttcaccatattgcccaggctggtcttgaactcccgggctcatgtgagctgcctgcctcagcctcccaaagtgctgggattataggtgtaagccactgtgcccggccttatcttttttttttaactttttatatataaaaaaactctcaaatacatacaagagtggggagaacagtatcatggccctatgttgtcccatccaatttcagctaccatcaattcatggccaatcttgcttcatttgcatcccatcctacttccccaccccaaattattttgaagaagaccccaaaccccataccattccatctgtaaatattcagtacatagctataaaagataagagctcaaataaataccacatactttgtcattttaaagaaattaataacaattccttagtactatcaactaatcaggcagtcatcaaattcctaattgtctcaccaatgtcacaatttttttccaatttattaaaagcttcattttaatgtgttttgtaaatcaggtatttaatcatttatccactcattctgttgaagggcagccatgtgccacgcactgggggatggtggggaatgagacagacatggttcctgtcctcaaagggggaagatgaccactgcacccatcatcatgaggagctttatggaagggaggcacaggtgcccaggcagctcgtggtgaggaaacccacttagcccaggatggggggaagccaccccagtgcgtgagccagagtcagttgggggaagactgaggaaggaggaagggcagatgggaagggaggtaggagcaggctcctagttggcccctagagcccggaagtgagtcaggagtttttattgagcaggaggaatgggcggtatttaagaagcccttgaagggtcgcagctcattggcaggaacaaaggccatgaaagggctgggcatggtggctcacgcctgtaatcccagcactttgggaggccaaggcgggggggatcatttgagggcaggagtttgagaccagcctggccaacatggtgaaaccacatctctactaaaaatacaaaaattagccgggcgtggtggtgcacgcctataatcccagctactcgggaggctgaggcaggagaatcgcttgaacccaggaggcagaggctgcagtgagccgagattgtgccactgcactccagcctgggcgacagagcgagactctgtctcaaggggggaaaaataagccatgaaaggctccatcccaggcagaggggctaacactagtgcagacgtggtggtgtggagatgcatcaggggagtgtggaggggagactggaaggcagggcatgggggacgcagccaaacacggagggtcttctgtgtcacactcttagcaggagaatgggatgctaagatcttgttttggagagaaggctctagaggtgaggactgcgggcagggacactggggaggaagcccagggcaggcggagggctgagtgcctcagcaggcaccatgacagaggaaggagcggcgctgggatcgggggagtgagtgagagggcagggcaagagtcaattgtggtcctggggaccaccgtggacccagggatttggggtacagggccttagttgattctcatctagactcctgccagttgctgacaccctgaattctggcaaacatggagacatcagggtggaaacacctggagccactgccatccaggtgggcgccttgagggccaggccccttggctgctttcccagcagcagcatggagcctggcacaggacagacctggcatagaagtgggagaaaggaacaccgcctgtgggtgcaggagcagtgatcagttagcaacaggggcccccctgcagccagccatccaggcagcaccagacagtgatccatttctatcggtgacagttctagaaaaggctccggagacagggactatcatgtgatcatttttaccctagaccgcttgaccgctttctgtctgaactgatccacctgctagacgctgcctcaacagtcctcgtttctattttattttcttttacttcaaagcagaagggctaatctgctgaggtggagatgagttttcacccactggcttttttttttttttttcagccaaagtttaagataaagtcaggactgcagtttcaacaatatttttaccctatcggagagtaaaagagtcaccctcccattatacctcattgtattcccagtgcctggcacagaatgggtactctacacacttgtggatcactgggaccacaagctcctctgtcaccgtaacaggagaatctaggacccagcagttgatgactgtgtgggtggcactgtccaagtctcaaagacaaataccacaggcccttcctgcctcagtgccagggtctgaaaaatgggaaccagcactttcagtcagttgcagggcaaagtcagagtttgagtgaggacctggaagaagggtttgagctgagccagacagatgggatttatcatccctgccctgcccctgcctctcagatgaatccctgacccaagcctaagtttccatagtgtaaacctggaggttagcagggtgggttaaggggaaatacatgagtggaggtagaaatgatattttagtacaatttgtggataataaagggttagagttccatggggcctccatttagctgagaaatggggaaaatggaaggggtaaccttttccagtgggaggcccagggactctgcagtatcccaagtctggctctgtgagtcattggtgattttcagagagtacactctgtaagaaacatgaggaatagctgctttcttggacaactctttgaattgaatttctttcttctaccatgccatcaactgtcattataaaattgaagatgtgtttctcacggggaaaaaaagtgttattacaagagataatcacaaacaactagacaggaaaatcataccaccgtcaaccaccttgacgtaactggcatttctagaacattacacacccaaaactgaaaaatatacattcttcttaaatgcacacagaacactcaccaagatagaccatatgctgggcaattagacaagtctcaatacatttcaaaagactgaaatcttacagagtatgttctctgaccatagaggaattcaactaaaaatcaataataagaagattatctttgaaagttccaaatatttggaaattaatgcctttcttaacctatggtcaaagaaggaagtaaaagagaaattatgaaacattttaaactgaattataatgaaaatacaacatattaacatttatcattttaagtacttatagcagaaaagaagaaaagtgtaaaattgtaatctaggtttctgccttaaaaagataccaaaagaaaagcaaattaaacccaaatcctgaaaacattatgttaaataaaagaagccagacacaaaagaccacatactgtataacctcatttacagtcaggcatcgcttagtgataggagtacattctgaaaaatgcatcattaagcgattgtgtcattgtgtgaacatcatagagtgtacttacacaaagctagatggtatagccaactacacacctagactacatggtatgacctactgctcctaggccacaaacgtgtacagaacataactgtattcaatgctgtaggcaatcatagtacaatggtaagtatttgtgtatctaaacatagaaaagatacagtaaatacaatattataatcttatgggtccactgttgtatatccaagtggtcgttgaccaaaacggtgttatgtggtgcatgaatgtatacgaaatgctcagaacaggcaaatccatacagagaggagatttgtggttgtcaagggctgtggggagagtgaatggggagtgactgctcacgggtatggagtctccttccagggtgatgaaaatattctggaattagatagtggtgatgggtgtacaaccttgggaatatactaaaaacgactgaactgtacactttagaaggatgaatgttatggaatgtgaattatatttcaataaataaaaatcaaacaccccccaccaaattaaacccaaggacagtataaaaggaaggaaatagaaaatagacaacagagaaatttaacaaagccaaaagttggttctttgaaaaaaattaataaaatagataaaccctagtaagacttatcaaaaataaaaagcaagaaaacacaaattaccaatatcaggaataaaagagggaatatcattacatttaaaggaaaatatgggactattacaaataacttacctcaataaattctacaactcagatgaaatgaataaatcttttgaaaaacaacttaccaaaactgacagaaaaagaaatggaaaatccgaagagcctccatatctattaaagaaattgaatttgtaataacaatgatgatgatgacaataaacttccttccacaaagaaaacttcagatctagatgatttcactgctgtattgtaggaaacattttttttttctttttttgagatggagtctcgcactgtcacccaggctggagtgcagtggcgcgatctcagctcactgcaacctctgtctccccagttcaaggattctcctgcctcagcctcccgagtagagtagctgagactacaggcaggtgccaccacgcctggctaatttttgtatttttagtagagacagggtttcaccgtgttggccaggctggtcttgaactcctgacctcaagtgatctgcccatgtcggcctctcaaagtgctgggattacaggtgtgagccaccacacccggcctgtagaaaacatttaaaggaaaacgtaataacaatcttacacaaactctttcagaaaatagagaaggaagagcacatctcaattcattttatattatcaaaacctgacaaagaccttacacaaaaagaaaattacagcccaatatctgtcatgaacacagatgtaaaaatccttaacaaaatattagccaactgaatagcaatatatgaaaagaataacacatcatgacaagtgagtattatcccaggaatgcaatgttaatttaaaagtagaaaatcaaaatattttaccatattaacacagtaaaggaaaaaattcatgattatatcaatagatgcagaaaatgcatttgacaaaattcaacacccattcatgataataactatcagcaaactaccaataaaaggagcttcctcaatctgataaaaatcatccagctaacattatacttaattcagaaatattgaacattaagatcatgagtcaggcaaagttttctactctcaccacttctgttcaacactgtgctagaattctagccagtgcaaggcggcaaggtaaaaacaactcctgcagattggaaaggaagaagtaaaactatctttattcacagaaaacctgactggttatgtagaaaaccctaaggaatctattaaaaagctactacaattaatgagtgaatttagcaagttttcaggatatgtgattaatacacaagaaaattaattttaccaaagacaggaaagacttccaccctaaaaacaaaacaacacaaaatgctgagagaaataaaaaaaaaaaaaccaaacatgtagaaaatagattatgtttatggactgaagattcataattgttaagatgacaattctccacaaaatgatctatagactgaatgcaatcctaataaaaatcacaacaaactattttgtagaaattgaaaactactttaaaatttatgtggacatgcaaatgatctagaatagctaaagcaaccttgaaaatggagaagagaattggagggttcacaccacagctgacccctgaacaacatgggtccacttatatgtggatttttttttttttctttttgagacagagtttcactcttgttgcccaggctggagtgcaatggcgcaatctcagctcactgcaacctccacctcccgggttcaagcgattctcctttctcagcctcctgagtagctgggattacaggcatgcaccatcacacccagctaatttttgtattttcagtagagacgaggtttcaccatgttggtcaggctggtctcgaactcctgacctcaagtgatccaccagcctcggcctcctaaagtgctgggattacaggcatgagccacttcgcctggccatgttttctcttccttatcttttttcctaacattttcttttctctagcttactttattgtaaaagtacagtacataatacatatacaaaatatgtgttaattggctgtttatgttatcattaaggcttctggttaacagtagtctattagtagctaagtttttggggagtcaaaatttatacgcagcttttcaactatatgaggggctggtacctctaatccctgtgttgtacaagggtcaactatatttaattataagtctaactataaagttaaaggaattaagaaagtgtggcattggtctaagaatagacatacagaccaatggagcagaatagtgtccagaaataaaccctgtacatataaaatcaattgattttcaatcaaggtgttggatatctagaactaggtatctatatggagaaaaaatgaacttcaaactcctacctcataccatccacaaaaattaatgtaagatggattatagaattaaacattaaaaacttataagcttctagaagaaaatatagaacatctgtttttgtattcttgggttaggcaaaggtttcttaaagaaaaattttaaaagactaaacataagaaataaatttcactaaaaacttgcatttcttaaaaattggaaactctctttggctagtcacagagtaaaaaaatttgaaaactcctattcataaaaaaattacatttaagaaggcaagagaaggcaagtcacacacaggaagaaaatattcacatttatctgacaaaggacttgtagccagaatatataaagaacccctataagtcaataataataagacaaattatgaaattttttatataggcaaaagacttgaagagacactccatagaataagatagacatatggccaataaacatgtgaaaatgtgatcaacatcctaagtcattagagaaatgaagatcaaaattccaaagagatactatttcacatgctctaaaatagctaaaatgtaaaagtctgacagtaatcaaatgttgatgaggatggaacaactgaaattttttttacattgctgataagagtgtgaaatgatgtaatccccttggaaaactatctggcgatttcttttttttcttttctttttttctgagatggcatctcgctctgtcacccaggctggagtgcagtggtgcgatctcggttcactgcaacctttgcctcccgggttcaagcgattctcctgcttcagcctcccgagtggctgggactacaggttcgcaccaccacgcctggctaatttttttttgtatttttagtagagacagggtttcaccgtgttagccatgatggtctccatctcctgacctcatgatctgcctgcctcagcctcccaaagtgctgggattacaggcatgagccattgcgcccggccagcaatttcttataaagctaagggtacctatcctgtgacataaccattctgttcttgggaatttcctcaagagaaataaaattatattttcagaaaaagactcacatgaatgtttacagcaactttgctcatatagcccaaccctggaagcacccaaaagtttatcatcgacagagaaatggaccaagaagttgtggtataggcatgcaacgggctatcactctacaataaaaatcaatacgtcacttatatatgcgacaacatggatgaatcacaaaaacattaccttgaccaaaagaagccagacacacaaaaagtacattctgtaggataccatttatgtgaagtttaaaacaggcaaactgatctttggtgctagaaatcagagcactggttactaagggactagaaatcgactggaaagggacatgagagaacatgtggaacaaatggaaatgttctatgtcttgattgtgtggcggtatacagggaaatgcatttattgaaactcattgaattttacacttaagatccacgaatgtaagtttcacctagttttaaaaaagaagagagactcacatctaaaatacctaaaacttgaaaaatattatataagatgaggaaaaaattatttctgattacatgctactaaaaataagctacaaatgtgattcataatagaagaagccatttttatatgtagcacataacttaaaggtctaaaggacaagcaagctgggagcagtggcccacgcctataatcccagcactttgggaggccaaggcaggaggatcacttaaagtcaggaatttgagaacagcttggccacatgctggtgaaaccctgtctctctaaaaatacaaaaaaagttagccaggcgtggtggcgcacgcctgtaattccagctacttaggaggctaatgcaggagaatcacttgaacccaggaggtggaggttgcagtgagtggagatcacgccactgcactccagcctgggtgacagaccaagactccgtctcaaaaaaataaattcaaaacaaaatagaatgaaggagaaacaagactatttagtagactgagaatagctgtttcttattgagggataaactgcaccaaatgctgttgtaagcattattatttccttcattttaagggtgaggaaacaagggcaaagagaagttaattagcttcatccagggcacgcaaactaggaagaggcagctgggatttgaactcaggggctctggcccaagagccttaacctctatcctacgccccctcgtgcttgtaaaggacttgatgctttacttagactttcccacaacagtttcttgtcatcctcgtgatggtcccaggacacaggctggtccaggataatgacccccagctaacagatggtgagtctgagaccccaaggggatggatggccagctcccaggcctccagaccaggggccattgtgccagaccgcacacctgagtgggcctggctttttcctgcacgcaggggtgcttgggccctgcttcctggtgctccatgggagtatctgtccttcaaaatgaacagattgatctgaagtggggagagagaaaatacagcaggaccaccactcagagagtcgctgtagaggaagagagggagaggagacgccaggacatgggagcgttgtgggagggaatgggactatttgctgagctttatacagcccagcccaggcagtgcatacaacaaggctttgctgattttaaataacgcgaggaaatagcagccccaggtctgagtcaccagcagagttttactctatttctcagttcccacagggacaatagcaatggcgggcactgctgggagacaggccagtgggctgggccctggcaaaatcatgacgtccttgaaaacagtcccaggaccttctccttccccttcggatggcccaccacctcaccctctgccctttcgggaccccagcccctctccagtcttgcttccacaggctgctccctgagggcagaccatttttgcttttcccttcaccatcgggactcccctgttctgtgtccagctctttgggggctctactctctgctctacgctttcaaacatttccttacactgttctctctgcctggatttccctccttctccttgcttcccagtctctctgaatatccagatttcttctggtcttctagcgtcaatgcctgtgcctctgcaatgcctctttaatccattacattgagagtcattgctccttttcctgtgttctcactttatttacactttttgcatgccaatgacaaaattctgccttatatcatcggcagaattttccatgtctgatatatctccctctggattgtaatacgctcttaaaggcatcgttcagatttgaatgatcttagtacaactcccctctgtgaaggccaaatggcacacaagccaggagcaagaaagccctggttgcctgtggaaatgaatgaacacacatgggctggcagccgtgtccctgcacacctgccttttctcagaggcgtggccctagcagggtaagctgtctggaagagggagctattttgtgcagatggaacattttgtccccttaaatcatgtcccatgaaaggccaacatgccatcctgcttctgaaacaagcactgagctcgtctccatttggagaagatctgtcgtgtgggtatttttaaatggtgaaaggagaaatgggtatatctgataccatggcgcttgttacactttgagcacagactctgctattcatactccatctattgactcagggaggagtttatttcaaaccaaacagctcagctatcccaggagcagctgcctcagaaggaaggaggatgctgttctattttccccatctaacctccttctcactcgatccacaacagcctttccatgcaaggaagaggctattttctttcaagctttattctccattttccctgtggcaagaaaggtgattggatattgggatttgtaatggttttatctgaaagccatttaaaatgaagctggaatgtcaacaagactgacgctgaatggagtagatgtgaagtggaaatgaacttgaaacaagagatggggttagtcatccccctgatcacttggaacagatgatggaggtcccctggctctgctccagtgaacagaacagaaccacttgaatactgccagccactgtttgtacataccctcctgaaacggctcttccaaaatgctgaaggacattttgttttcttaataatttggcctttccactgtttctgtatgattgatgtgtttcagcaaaccttttttaaaaaagaatatctagaggtaaatttagctcatcatgtttgagaatattcaccatctctaaatccccagggcctaaatcaatgaggttttagcacatttcgaaacagaaccctgatgtataaattctgcaatggctgatttcacgtattttacttcctctctaacaaagctatggaaaaatgcacaagcaggggagggtttgagcctcggtgcttcctgcagatgtgaatctgacaccaccttggagcagggcccctccccacccactcccaatcctccgctgggttgctccatttttcactccaagagaccccgcaggacagctatatccgaggcttattaaaatcttctaggatgcaaaggtctttggttattcagagcagcaggtctttaggggaagcccccatacacaaacatgctcagctgattctcaatttatattgtgtgttacctgcggggaaaattaaaagttcaaacctcaggcactttccctctcctcccttgattgcccgggggcttgttgttgagatatttcttgttgatttttttgttttttatgtctctggctggtgctaaacattctttctttcccatcatgtttacttcacatctctttgctgtatagatagcttctgctttatggttttttcctccttatctcagatgcagccagcccttccccacctgcccccgccccaaaacacacacacgaacacacaccctttcagactgcatccacactctctgtttcagtggatctgacatcaacgaccccgccacccccggccctcgtcagaggggagctctgcattgaactaggactagctcctgggtcataaaagttgctaggaccctggagagctcttactaaacagatgaggccaccaatgccagaggagagagatcatttcccagagggaacgagcctgctttgctgagcccccttccttgcccagcccccagacccatcacagggaaggttcagaggagctctgacccctccagtacctccttggcctgacgccgctctagcccgggctcccaggttttctgtagggagaggagcacagtctgctccacccgtgccatgggcttcatcagtgacaacccaaactcacccccaaataggaatggcttcaacctggagacagcccttcaatgaaatggtttatgctggtggagatttaaaggtatttgtctttcggctgggtgcggtgactcacacctataatcccagcactttgggaggccgaggtgggagatcacttgaggccaggaattcgagaccagcctgaccaacatgcagaaccccatctctactaaaagtaaaaaaattagctaggcacagtggcgcatgcctgtaatcccaactacttgggaggctgaggcacgagaatcatttgaaccccggaggcagaggttgcagtgagccaagattacactaccgcactccagcctgggtgacagagcaagactctgtctcaagacaaacaaaaaaggtgtttgtctttcaattacaaaaatcaagcatggtcactgaaaaaaaatttaaattcacattttgttttgttttgttttgtttttttggtctttcagccaggcgcagtggctcacgtcaaagtatgctgctttcagtatcttctcactctccctccccagggataaccactttcttttttattttatttatttaattttttttgagatggaatttcactcgttgcccaggctggagagcaatggcgcaatctcggcccaccacaacctccgcctcctgggttcaagcgattctcctgcctcggcctcttgagtagctgggattacagacatgtgccaccacacccagctatttttgtatttttagtagagatggggtttctccatgttggtcaagcacttcttgaactcccgacctcaggtcatccgcccgcctcggcctcccaaagtgctgggattacaggcgtgagtcactgaacccaggggggtaaccactttcaatggtttgagatgtttgtctcttcatagaagaaatatatgcatataatttgggttttgttttttttttaattaatggagttgtaatatacatgctgccttttttcccttaccatggaattgacacaggataataaattaattctaagcaacaaatttttctttaacccatcctgtctctaggtttctcctcacagaaattacaaccccttctcttgtggttccatcccatccctaaaacagtatttatcctcccttctctgtaccattactgtttcttgtgagaaattgtaccttggagtatgtactgaatggtgttgtactggaggcatggcgcggtgactcacgcctgtaatcccagcactttgggagaccaaggtgggcgggtcatttgaggtcaagagttccagacgagcctggccaacatggtgaaaccccatctctactaaaaatacaaaaattagctgggcatggtggcgggcgcctgtaatcccagttactcaggaagctgaggcaggagaattgcttgaacccaggaggtggaggttgcagtgagctgagatcgtgccactgcactccagcctgggaacagagcaagactgcatctcaaaaaaaaaaaaaaaaaaaaaaaaagtgtttcccttgcactggtgccctgttggctcctggcctcccttctagaccatcagctacctgtgggtgggagcctgtgcctttgtcattggtccatcctctatcccgaggccccgggacatggcctggaacatcagagactccagcggctgtttctcaaagtgaactgaactagctggtgtttcccacacgttggagccccctcaacctgccctcgattctctcctgacttatttctccccacatcttgggccagttccaactggactagcaaagagggcagctttacctctgtgctcccaacatgccctactgggtggcgtatggatgggggagcctgggacaatgtgtgtccatctcacacactctctacttcccatgccagtggggaaagtgggggcaggaatagagcccgggagggaactgccagagaccgtcttctctgctaaggctgacaggaagatggacaaccatgacagtggtggaaggggaagccccttggcccacggggaatggctgtctgggagctgacttgttgttgggggcctggtttgggcaggagcccctggggtggctgcagaaggaggctgggcttcacagacccctgtcggcaggcaggggctacgccccctataccaggcttctgctcagggcagcagggcccggagccaccagcagagctgaggaggctgcagaggaggctgagagatccgtggaggaagagcgtggtggaaaagagtgcctgaggtccgcttccacggccactctgaccagcctgggccttctgtgccttagcattcccgttcctaacatggaactcatggcctttgaccctcttccctcacgaggctgctgagagggtcagagaagaagccgcatggggactggcctcgccctgggagaggtgtgcaagccacgaggtcccatgttgcatgacaagtcaaatgctgttaggacgactcccaggatgaggaggtctgaccccacgctcgtcgtctggacagctctgaccctagaatttatttcctctttccccacagggcaatccttctactctcgggtcctggagaactgtgaggatgtggctgactttgatgaggtaggaggcccaagactcccccctccctcagccctgagcccagaggggaacaaccacccttcgctgcctcctgtgggcacacactggccccaaatcccaggcgccggcctactctgagcccctcacctctcagctgcttcctgaaggaggtggtaaggagggtgtgcaggaactccctcccgcatgttccccccagaaacctctgcacaggtgaggcccgtgtgcaaatgacacggggaacagcaacctggcccacctcgacggccctgctgggtctgggcctgttattccctgtggagaaagagcccacaggtgctgtagacctgaatgtgagccaccagctgagggcccaacgaggcaggcgagtgctggggacgtcgcaaaggccagtctgtgtcagtccccaggggttgaagagcagggcagccccgggcactgaggtgggagccccagtcaccagggaaacattgtcaagcaccccacgtgagtgagggcgccatctccagaccttgaggggaagcatagggaacagaagacagtctagattttcagcaacagctctgggggtgccatcagaaaagacgtgagctgctggtctattgacaatgatttttctcaatcctcactccagctgggctgttgtcacaattttatcagcaaaggagcaggcgacaccatcccacaggggtgcccaggagcagtgagaggacttacaacgcttccctctccctgcccgtcccctcggcacgtggccgggctgggagccctattctcacacacacaccagctcgagcagcctgcggcctcctccgcctcctcacattctttcgtctatgtgtttgctgcttccagaatctatattcccctctggctgctgtagtttctccagggttgactttggagtgagggccagcagtcatccgtcaccatcttagcacaaactggaagccatgtagtgaccctcaaatagtgtaccccctctctcctggggttggctctcccgcttggctctgtgggggctgggaagggcctcatagcagactgtgcctcttgaggttggctgctggcgttcggctgagcagccaccaggctgacacttagcaccagctgtctccccctccttctgaaaccgggccacacgatgtggctgtgtccatcgacccagagctggagacacagggagcaaaacctcgctcctcactcaggcttaggcacagccatcaaccatcgcggcccagcaccacaccctccccaaccacttcagggcgcagttgccacgacctccctggtacgtccccactgctatgcaggacaggtgaatcactcatttaaagtgaatcactagagctaaggaagtttctgtccttaccttctccccctcctggctgtataatgacctcagtttctaaacccgccaccatctttgtcaaatggggttggtgatgggtgtgaaggtctctgtgaaatgatgaacaaaatgaagggttatggtgagagtggaatcatggctgcccactgagacagctgtcatagatgcttcaggcttgccccattacacacccggcctgctccctcccctccccatttcctcagtcagggcactgggctggctgggagaagatgccagcagcctggcccagtttcccatagtcctacctccctgggtttctgcccactaatccaccaggcacagcatcttactccctcctcccaagactcccaggggatatgtcagcccaggcgttcagccagggggcaacctgatgccccttccaagggcactgccacccttttccatgcccagcgccttggacacctgagccacaggtatgcatgacattcaaagttaatcaccgtgtcgttcctcttcccaactctgcccagcccgcctcagggggagagtctgtctctgctggccctgaacaaggggccacattccgagcatctagtgcatgccagccgggcttgagatatcccagaggcaggaacctgggctcaacaccccatgatgatttgtatgggagcttagggatggggtagccagagtcagtgtggagagactggggcggggcagaagcagttatggaagaagcacatgactagggtcagagagcagggcacacgatggggagaagaggctcctgcccggggaaagtgctgcccgcccactggggagacagggaagtttctggttgttgcaatgaggagcctactggcatttagtggggtggggagcaaggatgcagaatgacttgcaatgctcaggccatcccccacttcccacctgggagccccgtgggaagatggtggcagccccagcagcagcactgagctgcttcctgagccatgccccttccactcaatctctgaaatcatccacagatgaaattaggctcagatggtaactacccttccccaggtgacagagctggaagcggccaagccagggttctgaattcatgcatagattagacctaagccctctctggatacagtgataggacctgactcccaccacccctgcaaggcccgtgttggagtctctccacaccccctgcctccatttctccctgggcaaagtggcctcagccctggccaccaatggtcagcagtgcacatcccacaaagcaggaaggccaccctcccattccctgttcaggaacggcccagaggcctgggtcagcccagtcccaaaggtagcctggagccataccctggctttaacctttctccctagacccagtggacatgttgtaaacttccctggcttccccctgaaagaatctgcctgccagtggttccagaatatcctgggaaagaaccctttcaaatccccctgaaccttcttgactttccagaaagcctcttctctccgccttactctgcccagggcctgccggagccagcttagtgagacacactggcctgggagtcatgagacctacaccacagtccttgctgaggaacctctttgggctttggattccccttctgtaaaagagagatatgctccctgctctatctgccccacgggactgtcacaaggctaaaaaaagatgaaatgagagacaagaaagcaaatgtctctcacagctctactaggtaagggattccaagcaagggagcggcccctcctctgctcaggcatgggtgagaggggctgcagcagctgggcttaggaacctgagtggggaggaggaggccatggaagaaagacaatgctctctacaacaatgggtggaaacagagcctggacatggtgtctcctttcccagaggctggaacctgagcccctacatttaacctacaacactggaaaagctagggagagacagagaaagacccagcctttgtgacctggggaagcaggagtagccacctttagccagtttggtttggctctaacacaggccctgtgtggaccaggccccaggggagaggccagagtaacaatagtacttgtgccaatgataagaagaactgctgctatttactgagcacttagtgtgtggcaagatgggctgagagcttgacacaagcattagactcactagaacttgctggattggtagcatcctaggtgataaggagccacaccaggatttaaacccaagtctatctgattccaggacctatggtcatttgtaaagtagacaagactcagccctgccctcagggggctcagtctagtgggcagatggacccactacaaacaaggagggaccctgggccttctgagccaagaggaagaagaggtctccagcctgggggatgacagggcaggggagcttggccttatctgcccctttctgtttgtaccaagaagtcatggctgttacctcctggaggccagaaacgcacctgtcttgttcgtcattggcctggcacccagcatggagttcagaaaatgttgccgagtgaaagaatgaaaaaaacagtgacattcactaagactggcacctgtcaccgcaggcctgtgcccagaccgagtgggctcagcagggctagtggtacatcaagccctttgctgtggcctggatagaaaagaagcaggcaaggcacagacgagatcacctaaagggactttagatcaccttgatctctaaggttagatatcatctagtttaaccctcttgtcttgcagttgaagaaacaggtcttagagtggggaagagaattgcccaagaagaccagctgagatctgagatcctacatttaacttacaactctaaagaagctggggaaagagacagagacaaagacagaaacagagagagagagagacagagacagagagacccagcctgtgtgccctgggaaagtgaaatagccacactagggatactgagcccaggtctttaagctcccaaatccatctctttccattgtactctaaagcagcagtccccaacctttttggcaccaggggctggtttcgtggaagacagtttttccacagactgggatggtggtagctgggggtgatttgggatgaaactgttcctcctcagaacatcaggcattagattctcttaaggagtgcacagcctagatctcttgcatatgtagttcacagtagggttcacactcctatgagaatctaatgctgtcactgatctgacattagatggagcttaggcgggaatgctcgctcacccgcggctcacctcttgctgtgtggctccgttcctaacaggccatggactggtactggtctgtggcccgggatatggggacccctgctctaaagctttgtagtgcatctcaatattttcccccaaacctatagccctgtccctttaaggatgctaccttgctgatttaggatggttccaggcccagtcagtggccaagctggacataatccagatcattctccaaggtacatcagggaaaccttttttacagagtcctagatcactggggctgataggatgcagaaccctgcaccccggccagcaccagccaggtcagggctaagcctagaccaggaaactgggtcaggactcagcactccccgggctcctgagaccaccccctccaacagaggccctctttccctccctatctgtactacctaccaccttgcttctgtcaacagtcctatcccaggctgctattccaggtctgtgtctgtctccagaactatccaggaccatccccaggactgagaaacaaccctgcatccctgcgttctgcacagcgtcatgcacagagcctggcacacagcaagtgctcagcaaatgttcgcccccagcatggggcttgctggctcgtgacatcttgagtgactgtgtttggcttaactgctacttgagtccccccgcagtaccaggcttcaggagaggattcagtatagtggattaagccctgaggactgaactccagactaagcgtcctgagacttgagtttgaatcctgcctctgccaccaaccagccttgtgcccgcgggcaactctcgcctctccactgtcccacttgtaaaaggagcacatctttgccatgttgctgtgagcttggttatgggtaaaaggtgctctggaagtactaagtgctacccagatgaaattcttccttcagaagcccttttccttcagtcttttccttcagtctttttttttttttttttttttgaggtggagtcttactctgtcacccaggctggagtgcaatggtgccatctgggctcactgcaacctctgcctcccaggttcaggtgattctcctgcctcagcctcccaagtagctgagattacaggcatgcaccaccacacctggctaatttttgtattttagtagagacacggtttcaccatgttggccaggctggtatcaaactcctgacctcaaatcatctgcccacttcggcctcccaaaatgctgggtttgcaggtatgagccactgcccccagctccctttccttcaatctaatagctcacaagttcaataccatagtcagaagaggagtgtagctcccaaaccctcaaagtcctcatctggtcttgctgtgttctcagcatatcaccccaaatggaggaaagaacataaccacaaaaatgaggagacaatgaaaaatgaaattagggaagagaagatgcagtgaaagagacacgtgaaatccacaggccgaggcagaagaggaaagtgatggcggcaagggggagggaggtggcatgacaaggagacaaggcagctgcagacctgcacagagttcacactgggaagatctaaactaaacacattctgcagtgctgtgtcacttacgactgctgtcacctgtgagatctcatttgattctctcaatagccctctaaggtagatattgtcacccccgcccccaatttcacagatggggaagctgaggcacagctagtgagtggcagagccagggctagaactcaagtctcctgactcaaactcagagtttctgcaacaccacggagactcccagtctgcgtgagatacaagcctcggtgttgtcagaagaacaaaaaagaagcaaagggtgggcatgtcctttggagttctgtgaggtgcccagagctcacagacgctgcctgagcaaaggaaggtgtcagcaatgggagatggggctggaaatgctgtctgggcacagcaagggggcctgtgggtgctaggaaagggaatccccacctctttcagggagctgtagaggagccactgaaaagttttaacaaaggagagataaaaagaggaaaattcaacccaaaaagtctccttcttacagtccatgcctctacttccagggaggccaaatgggagtaacccccagtcccagaccctgagtcacttccctccagccaagaggcccgtcaccctccaaggccccacactgatgccaggaccccacctagaggtgccggcttgattggtctccaggcctgggccttgggatttttaaaagcttctggaatggattgcagttccagccaagatgaagaacccctgagagagacagagggagacagagacaaagggagagatagagacagagagagaaactgatgaaagaaaacagatgtggtgaggagaagaaagcagaggaatgacgcgagagggaaggaaaagaaatgaggggaaagcctcgtgtgggtggaaaatgcgggagggagacaggggaggaaagaaaggaatctgtaaggggggagcaagtcagagaccgaagaagctgctgtgactcagtgaggaccctgtcttctccctcgcccagaaagcctccaagaagaacattcccccctgacataggcatggactgcccagacccggctgacgaatttctgaaagggcacctgagccacacacctacacgaacttcccctgattattctcatctgcagtcaggggccccggaagctccctgtctcctgtgccctccctgacccccgactctcactcaacaaacaggccctcgccccgcagccaggcagcctccctccccaggtcccttagcctcagcctcccgccaccgttcaacaccccacctccctttcacagggccatctccaaagtcatgtcctttttctcctgatctttctctccttccaatgccaaaatcccacccacagaccctcagggggaccaatcacccctcccctcttcatccccagtaaaccaaatctcggtggctcctgcggcccccccaactcccacacagcgccctggctgatgagctgggccttcctgggctgctttatttccctgcagccctataaaagcagcttcattaagaaaaccacacactctgctgagctgccagaggcatccagaagctggagccgcagccgctgaatgaggcctgtgggccgggctgcctccacttcctgggactctcagcccacccttctgccctgtgcccacctcgcctctgaagccctccctaggccctgctcagaaccctccccaccccaccccgcagacccctctcccgctcctctgcttcttcctccctcccttgccagtcctgaagggagatgtcacaaaggccgttttcctgagacaggccctgcccacactgggcagtgacccgcggtgctggcccagtgtgcccaagccctccaagtccccaggctgggagaaggaatctcagctttgggaatggcaaacgtgcagggtgggctcacagaagcctcctccccagggcctgctcagccaccaacagagtgctccaagtcatgcatctgctctgaggccgagttccttgtttatagagcacagaagccattacccacctctccagccattggaaagactaaatgaatgaatatgcacatagagcattcagacccctgcataagaaaaagttccccagaaatggcagcgattattactattattatttattactggactattgagcagtctgaatttggtagggtataaaaatggaactaaaaaataaaaagtcactgccttctaccagatctgtcaaaatcctccctgacacggtctctccacagcgtcttgagcagacctcagcgctgtctggtcctgtccaggagggcttcctactccagtctggcatcctgttcacccctggccatcctccttccctcatgcttgtggctcaggatgtggagtgggacagggacccctgctgaggccctccacatcctcccctggtgggaagcccatggaaaaagtgtcctcagatcactctaccccacttgggcaatggagcgcaaatcgatgacttgccacagccaacagtggcaggctgggctccttgccctgccgtgctctatgggtctcctgccagtccactgccctgcagatgccactggggatttgcatgccacgctgcccctcttgcggtatctaatcaccatgagctgtttccccaagaagtaccacaaaaacactacgcctaggacagaattcttcccatctttcccttgcccagtcttctttcccatcccaggaaggtgggctgggtgatggttggaggtaacagggcctttgaggaagccctaggaagatgtctggctctgcccattggcagctttttacagaatggggcactgggccactttagcctctgttttgagccattgttgccacttctggggcaccaggaaaaatcccaatcaaattcctactcatcattaacattaagttagggaggaaggaacaaagaagtggtaagggtgaatctagaaacaatgagttggggacaggctgtgggcctgaccccaataacactaatcagctcaaacctgtccccaatgttaccactgacagagtgaggagtggtttgaactcaacacaggagtctggggcagagcctgtgccagtcagggtgattctgatgagagagagctggcagctcacagctccattcagcacccatcaaaaaccaggctcacacccacattccttgctgtctccctgggacccgaccaccaccctggttgcaccaccctcccccaacccccctcaggagctgggaggccatggaagcagcgctgtgtagggagtcaaaagtcctggtaggtccaggctcttcacctaccacatgaccttgggcaggtcctccaacatctctgagcaccatctttgaaagaggagtgggcatcaatgccggctctacaaggtggttgttggaactaaatgagattccaggtgtcaatgctttgtccctggggagcactgggcccaagtgaggggccactctgactgttggagatccccaccagagattcccctcccacaccccatggctcctacctgttattgccaccgaagccgcagttgtccctctctccccagacgtttcggtggccggtggccagcagcatcgacagaaatgagatgctggagattcaggttttcaactacagcaaagtcttcagcaacaagtaagtgtgggatggggcaggaggggctgggcctggacgggctgggagcctgctcttctccttgggctaccctctgtttggggcttaaaagggggacctacactcccaacctgccctggattgattttcaaagactgaagaagtcttgggctggtctttgatccccattttgatccctcttcttgtcttcagaatcccccagttctcccagctgctgtcagccaagaacactccaccctcctatcacccctgctgtctccaaccccatcaaagcttcctgtctcaaagacttaaagctttaagtctccctcaatgccacgctggggtacagttacccattggagaggcgaaaggtggaggggctgatgatctcctccaagagacactctgtagccctgagggcaggcttgacagtttggggtggtggtttaggagtcaggcaagcctgatctcagacactcaggtcagtcatctactgtgtgaccctggaaaggttacataacctctctgatttcaatgtgctcatgtgtgaaaaggacaagtatttacctcaaagggcagctgtgtgaattaaatgagatagatattcactcactcattcaacaaatgtttactaagtgccgattgggtatcaggtactgaattaggtgatgcagagggcagggtgcctaccttcatggagcttgcactccacaagtgaagtacacctgccatacgagcattatcactataaggtgttcaataaaagtagttgtcatccttctctctgggccatgagaagaattcagaaggatttgaacacgctggaacagtggctaagtaatatcttgggttaaaaaatcacagccaggtgtggcacacacctgtagtcctaggtccttgggcagataaggcgggaggatcatttgatcccaggaatttgaggctagcctgggcaacatagtgagatcccatctctttaaaaaaaaatcggttgctcttatacaagctggaggtcatggcttaactgtaacatgtccaagaaggtgtggaggtgttagctcactgaggactcagaatgactcaacagtgggaggagactacaaacaaaagaaaagtaggcctcatcctaaatcatactaatagaattaaagcactcctgatctgagcaggagagacaaggagtccactgctctgatactggtggcagagaattcctgtaggcaccaccctatagtttccaggaggaaagggactttaagtgttaccttataacaaatggatgagagcctgaaagggaaaatcatagaggacatattcatccattcatccatccattgatccatccatccatccatccatctatcattcctgttattcatccatctgcctatccatttgtctgtccatcaattgatttatccacccttcctttctttcatccatccttccatcctttcatccatccattcatcaatccatccctccatccatttatcaattcatttatccacccatttatccatctatccattcatccgtccatcctttcattcatcctatccatccactcatcatccatccatccatccattcacccatccttcctttcatccattcattcatcaacccaatccttccatctttccatccattcatccaccacttaccctttcatcctttccattcatccttccatccactcatccatccattcatccatccttccatcttttttcttttcctttttttttttttttttttttgagacagagtcttgctctgtggcccacagtggagtgcagtggcctgatctcggctcactgcaacctccgcctctctggttcaagcaattatcctgtctcagcctcctgagtagctgggattagaggtgctcaccaccgtgcccagctaatttttgtatttttagtagagatggggtttcaccatgttggccaggttggtatcgaactcctgacctcaagtgatctaccctcctcagcctcccaaagtgctgggattacaggcgtgagccaccacttttggcccatccttctatctttccattcactgatccatctatcgatccatccattctttcattctttcatccatccttccatccatcatccttccttccatccattcatccatcctttcattcttccatccattcatccatccatccatccatccatcttttcacccaactttgcagtcactcatcatacatatagtgaacaaatgctttctgccagtcagacactatgctagtcactggagatactgagatgaggtattgaggcacagtccctgcccctaccctcccagaaggctttttgccacaggaagaggaaagaaaggtgtgtacctagaggcaggatgaggaacaggctgctggaagacagcagacaactgaaagatagccagcattttccagccaatgtgctgtcttaggaggtagtgagctccttgccactgggagagggtgagcaaagagtggaccacattgtagaggggatttccgagtcaggaaaggccccactgtatgggctccaaggagtctctgattctgtgggttttattaggagctttcaaaatctcagctgagtatggggcaagggcatttcagatatgctgtcagggccacagggaggatgtttagtgcacaaaggccttccctttgcctctcatggcatcacaccattcaggcagctgcttttggcacccacaagcaaggttggtgagacaccccccaccaggggcccccaaggtgaagcagagccttcttccctggggtgagataccatgagggtgtgacctatgaggacaggagaaacaggaacaagtggaaggctcacacacagaccaagtgggtgtgaaaaaggaaggagaatcagaagtcaagcaccagggagggcacctgagagcccctgaaggaacccaaccataggtgccaaagcatccaggagccttacagcttggccactacagccctagctgtgcaggaggggaaaccaagtctcagaggggaacttgaggtcacatgggtagacaatggtagagccagggctagaatgcatgtctgttaacttctcttcctaatccaactcccagaaaccaaaatatttgagcagtgatggtggaaactgagggcatggaagacattgttaaatcatttataatgaaagccaccagcctaaccactgaaatgctggaaacgcttgagcccatcaaaagactgctacaaacaaatcagaagtatttgggaaatcgggaaattgactaccatgccgtgaatatgttgaaagttacagcttctattaggtgtttttggtttttgttttgttcggagacagaatctcactctgtcacccaggctggagtgcagtggcccagtctcggctcattgcaacctctgcctcctgagttcaagtgattctcatgtctcggcctcccgagtagctgggactacaggtgcatgccaccaggcctggataatttttgtatttttagtagagacagggttttccccatgttggccaggatggtctcgaactcctggcttcaggtaatagacctgcctcggcttcccaaagtgctgggattacaggtgccagccaccaaacccagcctgtattagatgttcttaagtgccaataagaaggaagacagaaagggggatagttcctatcctaactctcttcttcttccctccctgcccccgtccaagagaaggcaggaaaccccacaaggggaggcccaggcctggtgggagaggttctgccatttctttggaagcctagagaatgcccagggcactgctggctgcagagctgagatgggaaagaagaggtccccttgtggagagcacaggcccaggctgacacaggccagcttgtgggggtcagagtgggacagaggtgtttggaatgatgtgagactcaagtctccccatcctggcatttgccagggccaggccagaggagcaatgaggccacagccctcaacccccacatggcccagttcagaccccaggctccttctcatggggcagctgagtggaaggggtctttgaggtctgcactaggcttagcaatgagcaaagccatggccactgctggggacagtgcctggcacatggcaggcccctgattattttgtggaataaaagaatgaataaatgcccctgtggtgttaggaggcagagggtaggtatacaaggtgggagagcctttgagagggaatcggagtggcccctcttctctgaaggactcagggcacccaagggtgacactcagcatcacatgactgatgcatttggggaaattgagctaaaagaggcatggaggagctgcctgggagagtggggcccaggacgagaaatgagcctgatcccatcactgccatctcagagagagagacttgtcctagaagcagagagcagcttggaaactggcccctcacccagtggttctagaggctgccaggaggcagagacatggtatgaaggaaggaggcatcctaggcagaaaccaggagacctccaggtctgcttggccccgtttggaacaaagacctgtgtccaggaaccttgggcttccccatgagaaagaaatgttcggttcagaagattttgtgcatccagctctgcctgtccgggacctctgagggtccatggcctggcctccagcctcctgcctgctaaggatgccagggaccctgaataattcaggagccgggacagcaggagaggcctctcagggcccaggacacctgacacgggctcccaggggaaagtgatgaattattgacaggattctggtgcccagttgccgctctattgtgatcagtctgtgggtccatctgggctggaggccttttcctgccggctaattacatggggatcttagctctgcccagctgcccagcccctcgtggggccagacagcctcctgtgaggggtgtcctctttgccatggtgacctggatggccctgtaaggcaagtagtcagaggacatggagttagccccagatcctttgcctgacagccccagggaaactgaggcccagagaggcctcttgtccagggtcacacagcaggttcaggacagtcaggtcttcaccccaggcctcctgacgcccgggccagtgctccttcccacagaacacatggcctcacaactccattcctagggaaatgactcagctgtctaaggagcatatgagcccacccttcctcaatcgtcctgggccccactctcccaggcagctcctccatgctgacccatgcagaggagtaagaacctactatgtgtgcagccaggatgcacaaaggccagctgcggcgggcacggtcgcctctggggtcaccacaagggccagagccaggggctcctcctacctcttcctgtcccagcttcttcccaaagaatatctatagaagacgggctgagggatggcatcctagaagcagtgccagggcctttgttttaaaactgttttcatggcaagcactgtgtttttgcttaaatggtatgttacagacctgtagaaagagtcaaggtttataaaactgcttttctttatactttacataaggctgagataatatcaattgtctatgtcaaaaaatataatttttacttttatttgagagaggttggggggtgaactgttaggagttaaaaccccccaagccactcctgggggtgtggcaaattgattcctttaatcttgcaagctcctagcgtcccaatcccaccctccgggccatagacaagctctggctgtgcgaggctgtgcacagcttgaagggtgggggacagcctggacctgcccctgaagcccatcctgcaaaggagactcgccctgtgtaggctctccagatggccagccctgctcattattagggaggggggaggggctggcatccgagtgccggtgttggtagaggaatttcacatgagcagtctcctcaccactgtccggtggaagtcggagggctatagcagaaggagccaaaaccacaccgctgccaggaggtggaatctcccttgggtcctgctgagtgagcccacatctgtctgactccagagcctaggctcctcactgtctacaccgcttccctttagggatggaattaatctgcatgtggacagggctcggaccagggtatgaagtgtaggggatttgcctggaggccaatctcactcagcacactgtgtgattaaggcagtggctgaatggactaccagtgacagccccatcactgtcaccgccaccagagtatctagcagggacttgaaagcacatgtcagggaggttgtttcagggattcctccgggaaggggcgctggacaaggtctctcaggttcttcccaagtataagatctgagattcaggcaggttaagcctagaaggcaccagacgcctctctgagcacttgcagggggaatagctccaccctgccccctgggagtgtcttgtcacattgcagcacctctgcagatcctgcggagctgccttggctgttcttaggcatctaattctggagaaagatgtgcctgatcgccccacgctcaacaggtgctcgacaggtcctaggggaatcaaggcagctgaatagccatccacaaagggtaatagcagagcagggattctcaaagtgtctccccagccagcagcttcagcatcacctggaaacttgtcagaaatacacattctcaggccctctcccacccactgaatcagagccctgggggcggggccagtggtgtgaactgaagtccggtggacccagtttggtgacttcacattagaagcttgaagttggccatggcgggagtatttatatctcagaaaccagcaaaagctacagatgagcacctctcctctcccaccagtgacacattttccagcatatccacagaggaggatatcccagccgtgcgtgttttcacaagccctccaggtgattctgttcatgctgaagtttgagaaccactgatttagaacaaaaaggggcgaggctgcaaaaagatgagtgtattctttcatgcctgtggtctactgttagaatgtctacatggtacggaagctaaaagtccccttccctcttcattttataaagaccaaattgagactcaggggcagcagctccagggctcctggcccccagcccagcacttctgtctctggggcactgcctgagctggggagaggtgcatgcagctatggaagaaggcttccatggggctgctctaagagcccagaagcccagttcggctttagagtgaaggagtggcgtggtcagtttcatcctcagggaggtggggcacaatggtggttggggctctgagctccaaaggggagcatttcatatccattcctcatggctgcccctaccacttcctcccctcacacagatgggaagatttttaaaaaatcaatgttcaccctccacagacctcagggtggtatagacatcaagcatgtctgagtcagaattcatctgatacctcacctcacccagatctaccattaattagctgtgtcccttccccttccgtggcctcactgtcttcctctataaatctcaggcagcatcagatgatgcccaaggtcccttccagctctcacatgccctggttgcttccctcgcctttgtgccttcagctagaaatggtgtgtgtattctaatccactctatgtggaagcaccatgtgagaatgtctgtctgagttccctgttctctcccagagcaacaaacagtcttctgactgtggggtgcaatggggttgaagtcaactccatcagcatttattgggcacccactgttgttcattaattcagccagcagatattgagatctctagtgtgctagaaatgtcaaacagaggctggaataaaaagcaccacccgtgcccttgagaggttcacagtttagaggcagtacatgaatcacgacaaaacggactgctttggagtgctggctgtgtgctgggggctttgataagaacactcgcagatgatctcattcagtcctccaacaacaactctgtgaagtagggcttatcagctcatcttatgagaaaaccgacactgagagagcttaaggaagttgcccaggaagcaggtagcttgctagtcagtgtcagagctgggttcagatccctgtctctttgatgccaggactgtgctgttaaccaaagcgttgcaccgcctctcccctgctgtgcagttccatgggctctgccatcacacaggttcctgccatccaggaacttacaggctgcaggtgtggaatggatgagtgagtgctgttggtgtgggctggaaaccttggtcatggttaggcgggtagaagccggaggagctacttgtccatccaggaaactcaggtcctttcccagcctccacattgagcatctggaagcttctctgcaagggctcagctaaagctggatttcatgcacctttccctgcagtctgtagacatcccctaagggtgcccactgccccttggagctctcccaaggaaatgggcctcccacaaacaaccatccacagtgggacatgctgccctggctgcaaccagtcctggctcctgggccaccttctctagcccagcccagagctggagcaagcccacctgagtcctccccaagcagtaacagcccttgggatgtcagtcttgctcctcaccctggtctcttccatgttaccaccgtgccccctctgccatccccaggctcatcgggaccttccgcatggtgctgcagaaggtggtagaggagagctatgtggaggtgactgacacgctgattgatgacaacaatgctatcatcaaggtgggtatgccccagggagttcctggactttcccatatggggccatctgggggtctgttctccctgcctcacacatggggtggtctggggaatgcctctcatgcatggcgaggtgtggcaggaggaggagactcaggtcagactctgctggaatggctcaatctgtggccatggctggaggccctgtggcatggcagggtctgctgccccacagtaggcacccctgcccttcctacggtgggaatgcaccaaccggtccttccatctggacccagctcaggagtcactaaagaggctcctttcatcatccaaaggccagactgagccctgctggcactcgagggcatgaccttcactctgcacatctagctcgggtcctccctgggagggcagggacctcatttcctattgtttgtcacatcccagcacttttgcatgagcacgcatgcactagtgatgcacagtctagaggcacctgacacatgttctaacaaagaaggaagcaaccctaccaggacagcctggccccaggctctgctctgattcttcagtcctcttgagctcagccgtggccactcatgggcagttggcatgatggtgaggaacagggaccctgggtatgaatcttaggctgctcactaactgtgtgacttggacaagctacatatcacctcaaagtgagcacacttacattatccacctcccaggactattctgaggattaaaggacaatacacagaaagtacttagaacagatatgcacaataaatctataatattgttagctatcatttcctgacctcagtttacccatgtataaaatggggctgtgccatggtcccccaatggggtcctgtgtaatatatggccgtatgtagtggccaagagaaacagcctcagaagccaggactgcagccacagggagctagaacagaaggaacgctcttctcccatgggcaggggtgggcagggagggcttcttaaagttaccagggtctcagccaccacagcaaggggagaaggggtgcagaataaactatgtatggacacccatgggaaggcgggctgggaggagaacacagaaacctggatgaagagtgtagggttggaagtgagataagagaattggggagtgagcagggatggacagacagcacagcccacgccctggattttcagaatcagacttaagatgtcagcagaggaaaggactcacagatctcctagcccacttgccacccatctccgctacccattcttatgaatgggaacaatgaagtcctggatggggaatggattcggccacagtcgacagcagggccagcacggagacccaggacttccaatgccagagaccaccattttcccacaacaacatacttggttccaccaagagggtcacatttgttccatggaaaggacatggggcttggagtcaggcagcctgggctcagatcccagctccagtacttcctagctgtgtgacttaaagcaagtaacttaacctcctgatatgctaggtaaggtaggttgcaatgttgaaaagatcaaatgagtgtacattaaagcatcttagcatgatgcctagcacagtgaggattcagaaaatatgtgcacctttcccttcccttgggaaatctaagcctgggtgttggagcatccaagcactgagtgagggccgcctgtctggggcacaggaacaagtcacctctagaccagtgaggaagggtgatccctgggcactggggggaaactagagctgcaagaaagtaatggccccaagacacagagcaggaagcccaatcatgattctccattgctaagcctgagcccagttgagtgctctactttttcccagaggaaaaccctagggcagctcccaagattccctccctctccagggtaggaagggtgagtgtgagcctgggccctgggctcctctcccggaggccactttcagctcattctgtcacatttccaacaagccgatttctggcgggccgtgcctcatgcctgcaggcagcccttgttctgaggagaggaggtggcctgatcatggggatgctgaacgacactctcggttatgtagacagtggactcagggggtgagtccaggctcagttgtgctgggcagggcaggcccctccaccttgagcaccagggaggagtggaaccaccagcagtgggacctggaaccagatcccagtaagctgacccggtctgcacaagtcagcctttcagagcctctgttttctcatcagcaaaagggggtagaggggatcataccatcctgacctcctccagtgaggcaagggtgtggaagcgctgtgtacacaccaccaagcagccacatatacggggtggagattgctgtcaccatcccagctgctcaccaccgcctccctcccttcagaccagcctgtgcgtggaggtccggtatcaggccactgacggcacagtgggctcctgggatgatggggacttcctggaagatgagtctcttcaagaggaagagaaggacagccaagagacggatggactgctcccaggctcccggcccagctcccggcccccaggagagaagagcttccggaggtaacaggcagggcccctctggctgcccactgctcccaagacacggggaagagacctggggcctggtcctactgacaggcctctctaggcctagctgggctcagagtacagggctgagcttctggagagacatccaaggggtgggaagatgtttctgtagccccccacccagccgtccaccctcgaggtcactgggcagggagcaggagactcagatggagctgcaaggccaaggcctccccagtggccctgagggaggtggagctctaacacagggatggggctagatctcctgcctttctcagagaaggggagatggggataggagggcccctggcctctctggttcaagacccagcagtgtccaccaggtgccggcagcctgacctctaccctggcccagtgaggaggcccaagacagggcggctcttcctgccagagtgaagccaaagatcctggctgggccctggcctttcttcctcttgagaagggagggtacccgggaacccccagaatccagcgtcacgccctgcaagtgtcctgccacccatggatcacaggaagctggatccaggacagctcattccacgtgcactatttttacaaaacagaaaatgcaattgtattactattagagaccaaagggacagaatctgggctagtctagtaagatgttgtccatgggttcctaagtcactaggaattatgtgttaaatgctagtaagtcaagggtgcatctgaaggaccagggtgtgttttgagaagggaccctctgtgccactggaaacatatccctgtaagctccttccacgctttcctttccaagtaaagtttactcagtccctctgctgaagaaaccataggttctaaattagtgtaattgaactgacatacttttatgggacacatatgttttctcctttgcacttgaatgagttcacacccccttaagcacccctcacacacaggtgcatgagtgcacacgtgtgcacatacacatacacacacacacacaagcttcagaaaccctgggagccagacgagtaatagtaacaaggtcaaagtgaccaggcctgcaacaaacatggcgggactgtctactccaggccagccacgggcatggggcagccccaggctagcttagagcctgtcccctcagactcctggctcttcagcagaaaacccaggcctgagtcctagctctgcctcttactggtcgtgtgacccttggcaagtctctgaccctctctcctcacctgcaaagaaggacatagcaatgaaatccccctgccctgctgctgggagagccggagggatcacagaggaacaggtggcaatggaggtgctgagcgctgcccatgtcccggctggtgacagacaaacaggtttcttgtagcacaacaatgcaaagagtcaggaatcgggttggaaattgtgagaagaggagcagtgctcagatggggagtgaagggatgctgactcagtgggcaccacctggtcctcctcgactgtctccattcagaaaagaggttggcagggctggtccagaaaccagaagccgggctctaagaaagggcttccagagaacaagatcagaagccacacaagggccatcagtcacagggaaaggaatgctggccccaaatcgggagagctaaggcccattaagtcccatctggactgtgccactcactggctgagtgacactgggcatgtcactagcccctgtaggtcagtaacaggaatgggttcagcaagttaaatctgtttcccctccaactctgatgtcctgagggacccatggacactccggacctgtgggtcacatccatgggaaacaacatcctgggagcccttagcagccacgaaggcaacctctctggggtggcgtagcaacacagagccagtttctcactcagtcctaagagagtgggccagggtgctgatgggggctctggagagcttagagtcccagagagccctgggcgccaggaatctggagataagagggctcccccgacacttcctcacagcctggtggcttccccacctctccccatcttcgtgtggcccctcccagggtagcagcaagaagcgggagcaaaaggaggggcttcaccccaggactgggaattgggagagggtgacagccgaagccaggcgcccccaccctgcattgcaggggcagtgtgcaggagcacagtttccctgctgccactggggctgccagtccaggtttgagagcacactggggacaggcgtctctgctataccttctcccgccaggcctagccatgcagccagcaggcctggttgtggaaaagaggggttgagaaaaattctagagatgggccatttgctggtgaggagaaggtggagcaggttcaagaacttggggttttcctgtagcttaatcctggctgcccatatggggccagtgagttctgggtcaaggagtgctgaggtgaggagggggacctggaagctggccccgcagccctagatgttgcatctcacccttgtcacatagtgtggcttctgggaggaagccagagagctctccagaagggacttggccaacctttgatcaggaaaacacctactccctaaagaggacaacaccggggaaggggcgtcagtgcctcacctctgaccccgttaggagcccaggcaggcttcccctgcatctgctccctgccctccatcctctcctgggaagaccaatccccttatagatcaggatattcaatatccacagttccctcttgttcctgctttagccacaatgagcaagaggaaaaccccgttgctggcaagcagcagtgtctcaccggccatcttgacagttagggtccggcgtggggatcagccgctccctggctgatggggtgaaatgaaggcctgctgggggctgcggggaggtagactgagtgggcaggaaacagcctcagcccaggcaggccccgggcagcccaggctggaatcttccacggatggaggggaggctgatgccaggagatcctctgggcactcctcacctctccctccagggcctgggtccaccccccagccctgccctgccctgcctggcctgcttctctgggacttcacccacattcatcctatcctcactctgggggtcagatggttctaagcaggggcaatgtggacctcaggcctcagctgctgtgacactcactcctaagaccctaagaatctgccatgaagttaccccgttcctcctcagggaatcagtatgggggctctgcctgaaagaccaccaaccccaccgcccactgactctctgccccaacgattccacctcccctaggccctggtcagccacatgccctctgagccactctgcccacttctctagttcctgccacgaagccctgatttctgccggctttttgcacaatgcccccggtaatgtgccaggaagctgtgctgtgtgacagagcacaggctccactcacagctctgctattgggaacccccctccccatttgtgagatggggctcaaggatgcctcacagaagtgccaggattgagtgaggtgcacctgcgagccacccacccctgtgcctggcatgtggcaggtgctcagccagtgttcacttccttcctcttcactgactccatgttaccctgatgtcaacttctaccctgagcagcacctgaccctcttgttcaggtgctgtccaagcaccttctcagctcttgctccccaccctataccaagggctctgcagaagctgcccacacaggagccttactggcccaggggcaggtatagggagctcatttactcaaagttcccctcacctccccaggctctcagtgttgcagagatggaatgaatccctaacctcatgggcactccactctcagcagcacaaaatccgtgttccagacccttgcatggcagcgtatgcctgccctagtctctggagagaaagtgacttcggccctgaccacactcacatgcacacacatgtgtacacaagtgcccatgtgtttgcacacactcacatgcactgcatgacaccagggaggactctggattctgggctctgctgttgatgctgtctttaggagtcacatcttagagaggacaaagaaagaaatcccagctttagtcttgcagctaaactgtagagacctgagcctttcctcctgagtccctgtattctgcgactatctcctcttctcattttctccacctggcctggctctcctgccctccacgacccccacctccttctgctgcccaaaccctcttctgctggtctcctctctgctgggtctcatctgggaggagtttggggcaggagccacttttctcattctccttattgatcattcttccactccagtggaggcctgcagaagccaggtaacttcctcctatgctggggccagagggcagtggggcacgtgtgcatggtggggctctgagacagaggggcagagagtgggcatgcagaagtgtgtgcatgtggggccagtacatgcagccttaccccaagagtgtttttaaatcggtttccacagcccctagagagctagaaaatcctctgctgcctcccttctccaggctgagccccagagttgcagcagctcccaaagctgctcagatgagccggggcagctgggcgcactaggattttgtgcttgagacacattcctcctcctctgctgtgagctcttctccgcttagtagtctcagctgatgtgggcagccgaggcctggctgatgttaacacctttgaattacagactgacctgcttgcccaacgtaaaggttagctggccagtgctggactgcagctgtgctgtgtctaggccttcaggtcttgagccatcagggtatgcagtcaagtctacctgggcaaggcctgtgccagaacagggtgtgaggagaggaataatttgctaattgttattcactttcctgtcttcatcctcattgccacagcactgggaaagcattgagagaacattccagaaaagttttctagaagcctccctaaagtgagataggagcgccgtttttccctgctctgagccctggagtggtagctcacttactgccccacctacacccctagagctgcccccaaccacccgtgtgcactccatagcaggacccccagccctgcctcaccctcacagagcaggcttagcccactgttcccctagaggcccccagagcctgggagctcccaccccattggaggggagcaggggagcaggggagccgatgggcagaggagcagggtggcccaggccgggagggtggccaggctcatctaaccctgtgttccctgaggaagctgcgacccacattgtggaatcaccagatcttagcctggtaggggcgatgagctgaggccctgaggtatcagagcttggggttggaatagtggccacccaggcccagcactgtgggcccctcccctctcccccaaggcagaacccagggccatgggacccctaccctgcagacctaggcttgctaccgtgcgaagctgtggggtgagaggtctgtgggacaaggaggcccctggggagcgtgcaggtccgtggggccggggctgaggccagtgtctctggtccacagcccctcacacgtgtccccttgtctcctcatttcttccccctactcagcaaaggcagagagaagaccaagggaggcagagatgacgagcacaagtaggtgtcccaggcgaaggcagacgtggcagcgtctctggggagacagaggcctcctccccacaggctgtggagggcgggatgggctcggctgagagggctcaggagtgggctgtcgtggtggagctggcacgggtcatggaggcccagggaggccttttcacctggccacgggggtgagggacgaggaggggttagggtcgggggggaggtggccagaccttctggtttccactctgggctctcgggggtgaccatcctcctctctgtgtcttgttcctcctccactgttcagcccccatcctgtggccttcgggcttccctgggagggaggggacagctaaaggctaaggggagaggggcacgaggacctcagggacccctctcccaacaggggcgaggtagggccaggcagctggaggcataaggaggaggaactctgggtaccctttgcagctgcaggtcgtgggtggagttggagacccccaggaagcttaggagaggccaccatttgggcagccctctgtatcttcatctccccaaaaggcttcctggaaaaatgaggtcagggtgctgtctggagaggacaggagaagggtcctgcaggtgggaggggcttgtcacaagggtctggaaagattcgaaggctgggggttgtgaatgggtcttgtaggcacccctagaagcacactgacatctggaggactctagcattacgggatctcataagggcagtggtagccaaggtggaccatactggaggaggcccctggttaacacctgctcttacagatgacaaatctgtctcagaacaggggcagagctggaaccagaagacagagaagctgacttctgacccagagctcaccatagacccaggaaatttagagaacttgactgtatctaaatttaatctaattctccaaacataccaatgagagctgaaaagccacgagtgtggtcttttttatcttccagataagcaacctgagccccagagatcttaagagatttgctcaaaactgtggcctcaatatattaagaattagttcatctgaagatatcatggaaatatcaggattgtgtgttgaggggtctgaactgatcaacactggtgtgggcttgggatatccactggcattaagatcctggggaactcacagcctcattcattgcttcaaaaaaaggtatgagttctaactcgcatttgttacgcacaagcaaaagcaatgatgatgcagtgttaactctgtagtgatggaggaaatggcgctgtgtaggaagagctccagcccagagacctgaaggatggaggagtttgccaggttcccagtaagggaagacacgtaggcagagcatgtgtcaaggctcagagccagggaactgaatccagggtgggtggcgatgatggggaatgctgagctggggagtcctcttagggagtcctcaagggttcaggtttctccatagatgcttagatgtaaagggcatatgaatgagatacgagcagcctgtccatccccagcttctctgcctgagatcagcgatgctctaaggcccttcttgatgcccagcttcccagtctgtcccaggccagacccacagggacacagactggcctgatccctttgactggctacagttggagtaagaggtacctcacagtgccagcacatagtaggtccaccaaaatactggttccctagcacttctctgtcctaatttcttaccatctctaattagcacatgagataaagtaaactggcatatagtattgttattattattatgtgtagagcaataggactattgaaagaataggaaaatgagatttctaagaagagattgaacaaatttaaactctttagcctggaggagagaaaactgtggagacagatttcaatctctgaaatgttaatgtgtggcaaagctggctggtatctatctccactgagaggagataaatggaaataaatttaagttgaagttaagttgaagtagagaaacaagattcaactcacgaaagaactcatagtgtgtgacattctgggataggctggtttggggagatgagaaaacacccatcatcttccatgatgctgcttgcttgagccttgcaaagggctgggccgccagcaagaactgaagagtcagcttccctgacaatcctggggtcaggacaagtgtgtgtgggtcccccaagccttctggtacaacgtgggcacatgtgcaaacgggccagtttggagacagggtggttctagtataaagggtcagcctatcctgcccacctacggaaagctattcaaaaactaactgaaattcaacgcactttcaaagacacctgtaaagactgaaattatgaaattccctgtgccttggggcatggaaaattttttaaataaacccatttaggggcgcttggataacatgctccgaggttttgaaaattgggctgtttgagcaatgcaaagaaggaccacagaccctatttctcatagataggagtctttatcctgattgattacctgaggcctgagctaatgagcctagtagttccagttgaagccagtcatggggcagaagccctgggcagtgaatggactcaacctgcagctcatttatggtcaggtctctattagctttcagaataatccagagacctgaattaatgaaacactcgggtcactaaatttagtttggtgaatgttcccaagtcattatgaatactaagctctacctaggaccctgtgtgcaccacacagcaacacccttctaaatctgggccataaaatgagcgaagaaatcatcagatttatagtttacaataagtgaactaattttagcattttttcctctagagataaataccagtctagattgtaggtgcatttcattctgaccatggtgaatgcagccacgggaaactcaaacggattctaaatcctcagagggtgctgggatactggcctccccttggctctcacttctcaagctttaatacgcccaagaataacgagccatttgattgtaaagtgagttttcactgagttgattattggcttgttttctttgtctgtttctcaccatatcctgtttttggtaattgtagaactcaactagaccaaatgcagaattttgctttgaaaacaaaaaaaggccaggacaacagacacctcaacagcaaattacattttttgaaatctaagtctttcagacaaatagataatcttcaaaattccctgattaagttgacatttatttcaaaactctcctttacagtttgccaagagaagtaggcatactgctttctgagaactggtgctgcaatcaggcagaaagggctttttctatagtgaacttctgatgtgttactgatcagaaaattacaaaggccagtggcagtgatgacatcatgctgtactgatcacaattcagattcattgaaaagcaagtctaggagaatcagaggtacagagcctgtagtaagaattctggaaattacatccttcactacacatttctgcatttttaataaagggacaaagacaatatccttttgagatattcccaggcacacaggagtgctaccagtactaccacttcagacagctaaaattatgcagggttggaagggagagatttctcctttcaattgcttcaaggtgtagtagagatagttggacaagtatagtttttgtttgtgtgtttgtttgagacagagtctcactctgtcacccaggctggagtgcagtggtgcgatcttggctcactgcaacctccgcctcctgggttcaagcgattctcctgcctcagcctcccgagtaactgggatttcaggcatgtgccaccacacccagctaattttagtagagacggggtttcaccatgttgaccaggctggtgttgaactcctgacctcaagtgatccacctgcctcggcctcccaaagtgctgggattacaggtgtgagtcaccgcaccggaccaggacaagtatagttttttaaagcctcaatcatttctttcaaatctgtttgtgttaagaaataaagtgactttcaaattcaagggccataagtgccccagggatgcctcaggtccttttccacctgggtgagtccatgggaccagcctctgaaagccaccatttcttgctaccttgcactccccccgggactcaggcagcagggccagatcccatcccagcaggccaggcagccggcttctccaggcagggcctgcttctaacctaccatctcagagcacttcccctctggggaagtggggaaggggcaggggagagggaagtctgtggctggagcaggctgcaatggcaaaggctaactatgtaggtcacacatggggaagggccaaggactccaagaataacacagcctaggaatggccaagaagtaatggtacaaagtcaaacgctgagccctgcaggagactcctgggtaattcaggagagagacatagttgagcagcaaggctgggcaaaaaggaatcccaagcactgagacaggaaggcccacaaaaactacacttctgaagctgggcctatggcagggtcaggacagccagcacccctgtccttggggccagcaggtggggcgaaatcccacaggatgcttcagggcaagccagccagggtggtcctttccccaccatcacacgattatttctggtgggttcattgatctgttcaatgttatgtcaccagcaatttaacatgcacagcagtcccttcccaaatgtttgggtgctcaggttctttttgaatgagccccttctttgtaaacatgggtatgatctgtgagattccacagatgacagcatcctgatctgtaaactatgctggcacacagaccatatctgtacctatgggtgccagccctggggccttttagctaaaatcccaaatggtcaggaatggatgggattcttgcccacagaaaaatgcagtcctacggcatcgaggcaaaggacccgagatgcagtaaaaatattgctggcctagaacacaggagctttctgcttcaatcccagttctgccactcaccgtgtgacctcgtgattattttcccctctctgagcctcagtctttttattggttgaatgaggagaagtatgtggccctcagaggattgccaggaagatgaaatgagcagacattgcagacatctggaaaggcctttggccctacgtagtctctttttggcctgtatgtgtgtgtgtgtgtgtaactcacctcccccatcagaagggaggaagcttttaaaaataattccaaaggcatcagctttgattttagagcctctttctttccctttcttctcattgtcgtatttcagatggtatgctactgaagagtgcagacacatcagccttcttccattcctttttaggaattcaaagaacacgctaatgttccctaaattgtgagctgctgccacgtgaaaagggtgattctcaattgctccctcactgggatatgaacgtgctttgtcctgcatatgaacagtaaagaaaggtcctggggttgggatagggccaggtttggggaataagattggctccacaatcctgaggagaggggcttgaggtttctaggtcatctgcctgaggacagaaaggttttccccaacctcctattgcccggcataaagaacaaggatctggggtcttagaaaccatagtcaagcctccacagggagatgtgtgacccaaaaagggtggactctgctgtaagtgagctccaggttggagcctacacctggctccacctggacctacaggatgatggagccatacccaggaggagggagaatgggaagtggagagagtcaggtatccactcatgcaatatggatggggtaatggaacactgcactttaccctctgctgatcctgctcctggggcttcctggcgccaggaaccacaggctcggctgcagggacatcactgaagggcagtgaggacccctgccccttttcctcagcccccctgactgcaaggcccttcacctgggggcacaaggtcgcagcaagccagaggaagaggtaggaactatggagcctgccataagttcctggggttgggggaaaggggaattcggcagtgagaggggacaggtagaaggggcaaactccaggaccggagatagatgggaaagggcctatctccccctttttcatggggaccaaggaggatcccagaacacggagaggttggagaaagacaagtcaggctttgagcaccagggccatctgagaactgaacagctcgtttcaaccacatctcccatctcctcatcggcctctgcccctgagtcctctctggtccctgccccgccgttctgatgctctgtctccagtcctcgggctttctctccaaccagctgagccagggaggatgagcgtggggacactggcagggctcagggctctgaggagactagactgaggggctgggatcagaccgaaaagtccaagacccagaggagctccagttaaaacggctctttccggctcaagaccacgttccctgcttgctggggaccccatccctctcctccgtgtgtgaaaggatggcaaaggcggaagtggaggggtctctcactgccctgattccccctcctggctcccaatttgggaagacagatcccgatctgtctcgggaccagtaggtgaggggccgggtccatctcccttctctgatgtgttctctcatgtttggctcttctgtgtttgtgtgttttcctccatgcgtccctctccctgcacctcattctggtggcccccctcacagagccgggaggagcgtgttctccgccatgaagctcggcaaaaaccggtctcacaaggaggagccccaaagaccaggtaggacaggtgccgcgtcagccccgcagccccgcgcctcgcggcgccctcccgccgcttgccagcccctgcccggctgccaaaaggccctcctgggataggtcgtccagagccatctgtgaggggcctggactctcattggctggcccagggctaggccccgcccagtgatgcgtggccctccaggaaggagacgccctggggccgagggagggaaacgggcagcgccctctgtcgggtgggcctagttacaaggctcgtcccgccctcgttgctcccggttcttccttcttcacgcagaagcccagagttttaattagagcagagaatatccatccatcaagaaacgctgtttggccaactccctatttctagggggaaaccgtcgtcccactagtgcggggtcggcggcaggcctcgcccgcgcgctctcaccaggctgcagcctggcctttggggaggtcctggggccgctggagggcgcggcagggcccggcctgggaggctggagcagcaggtggcactgcgccctcccggaggagcgactggagaggggaagacagctgctgcagaggaggcgggaggcctggaggaagacaaggggagaaatggagaggacaggggagctgggagggggccatcttctccatcacgggcccaccatcggggctcccggctgccctcccccagcatcccctctgtggcccactggccctcaggctctctctcccaccctcttgcccccatgccaattccagccgtgcccttcaccttcttaaatggagagagtacagctgctggctgagaaccaaacccagcatccttgggtggctgttcggaatccacatgtctgcatctcattagatgaatacacaccaatgcattaggttctgaattccatcagctatttgatatggataagttacttcctaagccttcgtttctgtacctgtgacatgagaataacgcccatcttggcagggcacagctctaaggactagagatactcatgtaaagtggtgttgtgcctggaacagagtatccacccaacaaatggtagctatttattgagaagtgcaaaagtatgaattctttattccctaccttcttccataagagatattcagtgcctaagtaagtggtatacaataaaagagcattcaattaaaataaaaaggcaagaccagacgtaatggccattcaaatccaagatcgggattaggtagaaaaacactgcagttattcaggccataacattctaagcggtagcaactaagtaaacctcaaatttaactctcagctttctggatgccagagtaaaaggagaaacagtcactatctcaccatcagtcagcccacctaaccagtctttcatcttccccagatgaaccggcggtgctggagatggaagaccttgaccatctggccattcggctaggggatggactggatcccgactcggtgtctctagcctcagtcacagctctcaccactaatgtctccaacaagcggtgagtggacgggagccccgcaaccccagctgcccccaccctgtcaggcaggacctggcttgccatgattggaatttgggtagggaagagtcagggctcatggacggctccttcctaacccaaccttacccttttctgcttttccttgggtgtttttctcacctctctccctgcaaaagcagagcacagcagctgcaggcctgttctcaggtccttgaatacctcccagcccaaggaagccacagacctgcccaccccatatttgaacctattgaccccatgtctgtctctctgttacttctgcctttgattagttctctgtgttgaggcctctgaaggcaactaatcctcactattcttggcagggcttgatgtttaaagaccatgcttctgtccctctgcccactcccaggtctaaccactgccagtgtcctcctcccccagaagcagtccccataccccaggcctgatggtacattctcttcctcagatctaagccagacattaagatggagccaagtgctgggcggcccatggattaccaggtaggtgggcacctggaggcctcatgtctttcagactctgctgtagtgggggattctagccggatgtgcattatccactatactgaggcatggatccagggtcatagagaaccacaagctgaatataagttcccaaagtaagcttgttcctgggaggcattcctagcagtatcatcagtagagtgatacaaacccaaagaaaagcttgagaactctgcctatgctaatcaaagcccttccagtatttcatgttcagtattggacttcataaagtgagaagcacctagaaaaaccataaggagaccaagaactacaaaaaagtattcaaacagttaagataagttaagaaagttttcctggcatgatttttaaattgttgttttgtattatttgattgctggaagtaatgtcgattctggttatctctggatggtgagactgtgagtgattttttttcttctttttgcttctctgtattttctgagattaacacaacttttttatttgtgtgcttctaagaccagagacaaaagactgagacaaagagaggttgacagctgtaagaatgtgaatgtggccaacagtgcaggcaggacaggtgatgagcatgtctggtggctgctgggacaccatctctcaggaagggcccagggaccctccattgctccagaccctcccttggaggctaacaagactcagctataaatcagaagactgttgggctttcctaggattgagttagaatgctggctgctcagaggggacagggcttgcgagagatctcacctggctgccactgcacttctgtcctggggatgttcggtctgggtatcagcaccaggccccagaatcagagtgagccccatctaccagggtagagctttatctttgatgcctagttccagaccccaagcacaccaacccttctttacggacaaccccacctcccctcactcaggtgatgatggaaaggataagatggcacttttctatgtaaaaggtacatctggccatgttttctccagaatatacttcatctcccttcatctttgttttagttagtttccatctactcaggcaactgtcttcccaggtgcctgaaaaacagccccaggcaatgtcaaacggacctgcccctgtggttttaaataacttcaagccattggattccttagcggtttgagaatcccggcccctcacctctgccaaaacccaaacgcaaagtgtcctgagacttccgagggcttttccaagggattgggctcagggctttgtttctctgtgtgctgagaactggagaattccaaagaacaacgaccccaactcaggtatcatgtcactggcctaagaggtaaggacacatcaaaaatagagtcattattgttcatggaacttatttttgaaggtttattctatgccaggcactgtgctaggagctatatatgtatttccattgtagttaatgtaattattcaaccacccaaatataggtgttactgcatttataggtaagaaagtgaggccccaggaaggtcaggagcttgtcccaggtcgttgccactaagttagccaaggctagagccagggttcaaggccaggggtgtctggccatagccataagagcaattgatttctatatatcaagccttctagacagctgctcccttcaggtccctggttcatcttcatcttgctacttagtgcttgttttccaaaccttttcaaactgcttcctaccagagacttttattgactgaaccagacattgtcccctccaaagactttttaaaccgaactgaacaaaacggttgttgtatttaacctggtagcatagtgtttcccgacaagttcattcacaattaaccttgcaaacatttgagtgagagctatgaggatgcaaatgtgaaattattttcacttccaatacatacagtgtataatgcaataaaaccaagccgggtgcagtggctcatgcctgtaatcccagcactttcggaggccgagatgagtggattgcaagaccagcctggccaacatggtgaaaccccgtctctactaaaaatacaaaaattagccaggcatggtggtggcgcatacctgtaatcccagctacttgggaggctgaggcaggagaatcacttgaacccagaaagtggaggttgtagtgagtcgagactgcaccactgcactccaacctgggcaacagagggagaccttgtctcaaaagaaaattaaaaataaataaattaataataaaaagcaataaaaccagatacgacttcactctcttggagactttgggtttgatgagttataaagacctcaggaaggacacctcgttggtgagatgtggggagacttagctgaactcagatccaggaagggttgtgagggctcaggaccattctaaaggttatggcactgaaagaagcctggaggtaaaaggaccgcggcgtacccatgctctttgtttcttccatttagaatgcatgtcacgtgtaaactctttcctgattattgccatctccaaggcaagaaaccacagtcacccccctgtgaatgtgcagtttccccaccagagtgagcaacgcttggcacttggcagagatgtttttggtggatcaagcggtcttgagtctcttcattaccatctcttcctggcaccaagacttaatacattgtcacccaacatctctccagttttcacctccatttcatgcccctgccactgacctgaggtccccagcctcaattgcatgcttgtacctactttctacctggtctccctgccctcatattgcctcctccactccaacctccatgccaccactggagcaaacttctgaaaatgcaaatctggtcatgtcacatctctgccacctggaaaagtggggagtgggtaatggatgttgcagaaggacagtactaaagggcgcaccaactctcatctctggctcccagcagatgttcctgaagctggatcaggtccctgggaagcaggtcacaaagcatcattactctcgggttttcccaggacaggggtatagatttaccactcagcattattacttgtgatcgctttcatgaagccactgggaggtgtgtcccttatcttgaaaggagatggtggaatagtcagctggtcagttggtcccagctgtggctccgtttgcctcttcatcttccaccctggaaaaattgagtcctctgctgatgattggagagaaggatggccaagcccctccccgagaaccctggagaatgaccagctgttttttattttttatttcaagtgcatcatttccccttcctagagccccaggaggggtgggaggcagcaggaatggcattccccttcccccaacaccatgcacgtggtggtctttctccagcgccctcagcttcctctcggggctgcccttcaaccagcagtgagcaccctctggagcttctcttccctccgttgctccttcaagcctctggccaccttcccctccaccctccgcctctactgccagagcttctgcccaggttgtcaccttcactgcctctgctacatggaggaagggagaaacgtatgaggcctgaaaagggggacagggagaagtagcctgtcttatggccatgcctcgagatggaaaacataaaaaccaaccactctcttggcagtgggaagaggacttgctgctggcttatcttcggtagatgccaaaaccatgtctgtccgcttcccagtcctgagttatagaaagccttttttattgttggtgggggcattagttgtggaaaaattcatggggtttttaaaaatctttggcaaaaaagggttcttggaagttaaaactctataaactattgtgcaaagaaggacttctagtgtccgtttgctctcttcacagtaaacttctcagagctaagttagttagtcctatttcctttttagctccctgaaggagcagtgaatattgaacttctgtgaagctccagattctaagcttttacttccgtccctttggcacttcacgttccaaacggaaatgtttgcttcctagttcaagtgtcacttcatttgtaaatatcccctttcctggcaatgttctcattaacattggaatttctatttccttaacatgattacttctgatgtgtagatttttaattgccctcaggttatttttcagactttgatggacactggatgatcattttagtggttattctttttcatggaaagggaagataattctctcaagtaaagtcgtatttagaagttgcatcaaagcacaactaaaatatgaaatctccaagatgacaggcatgaaaagcaaccttcggagtcgcattagaagaatgtgccgggctcagtggctcacgcctgtaattccagcactttgggaagccgaggcaggtggatcacgagggagattgagaccatcccagccaacatggtgaaacctcgtctctactaaaaatacaaaaattagccatgcggtggcaggcgcctataatcccagctacttgggaggctgagtctggagaatagcttgaacccgggaggtggaggttgcagtgagcctagatcgtgccactgcactccagcctgggcaacagagtgagactctgtctccaaaaaaaaaaaaaaaaaaaaagaagaagaatgtactgaggtccatgcttattctagctggggaaaggcttttcttgttaaaacacacgtttgagagaggcaagtgaatcaatcattctaagtatcatgcacaagctccctacttgagagatcaaccgcttagctgaagggagattctgttggggtcactcacattttatagagctttctgctgtttaggatgcattttgacacacatgatctcatttaacctgcatacaaccttacaggtagctggtgtctctgcttgtaactgaaaaacacaaggctatgtggtcatttgccctcacacctggcaacatgtcaggtctggggttcaatcccaagttcagcaacccccagtacatgcctctgtctatcttaccatggccaccctgacaggaactgacacctccaaatccaaatgagacctgatggcttaaaatgagcgttcgggaaaagtagtagtgacgtcaaaaattactggtgctctggctctctctctctctgtctctctctctgtccttatatctttttagcttaaaaagccaataatcggctggtcacagtggctcgtgcctgcattcccagcactttgggaggccaaggcaggcagatcacctgaggtcaggagttcaagaccagcctggccaacatggtaaaacccaatctctactaaaaaaaaaatacaaaaattagccaggcggggtggcatatgcttgtaatcccagctacttgggaggctggggcagaagaatcgcctgaacccaggaggtggaggctgcagtgagctgagatcatgccactgcactccaggcctgaatgacagagagagactcagtgtgaaggaaaaaaaaaaaaaaaagccattaatcatttgtggtaagctccacaaggaagaatttgttgcaatcccacctgtgcctggctccagcaggtttccaggaaacatttgttgcatgaatgaacaactgaaatagggcttcccaggatataagtaagattgcagagctggacgccacataaaggacacagcagagtgcacacaacatacaatcagtaggctgaaaaaggcggctcaggcaggcaccaaagccgcactggccatacaaacaaagaaattcagcaaacggagaggaggtagcaatgtggaaagggggggagccaaattccagaaatgcaaagacatatcagaggcctgcaggcttacatgagaattcctcaagcaggaaattaaatgcaagttaatgaaaactttgaaagctttattcctgagtgcatgaaacctgtgacatgggtttggcagctctttctgaagcagagccatcgacgctggggaagaacgcagggcacttggcatcacctaggagctttaaaaatacagattccaggctgggcacggtggctcatgcctgtaattccagcactttgggaggccgaggcagacagatcacttgaggccgggagtttgagaacagcctggccaacatggcaaaaccccatctgtataaaaaatacaaaaattagcccggtgtggtagtgcatgcctgtaatcccagctactcaggaggctgaggcaaaagaatcacttgaacccaggaggcagagggttgcagtgagccgagatcatgccactgcactccagcctgggcaacagagtaagactccatcaaaaaaataaaaatacagatgcctgagctgcatgtccaggattggattggattggtctggaggtggcctgggcatcagtgtttttaatgcctctccctcccttcggcccagcaagttaagtctagtgaacactgacttagaggttagccaactcatactcctctataaatgaagacactgaggcatagaaggagaaagagccaggatcacccagcagatgagaggcagtggtcagaatggagcccaggaggccagtgctggctcccgggccctccctctgaccctgctgccccagcccctggacccctgcgggaccaggctcctaggctcaggcagctttccttctggctcccccttctcctgcctgcaggtcagcatcacggtgatcgaggcccggcagctggtgggcttgaacatggaccctgtggtgtgcgtggaggtgggtgacgacaagaagtacacgtccatgaaggagtccactaactgcccctattacaacgaggtcagtggccctgtggggaaaggagcctctgtaaatatggcaggagggtggccccagccctccccaggagaaataggagtggctggaagtcaaggagcacacagggctaccagcaggggtgatccaccctgttacaacccccaggacactgacaaacagagccacatcctctgaatcctctgaacaccccagtctagagcacaggccgacactggtctttgaagcgtacaccacccgggtgctcctgtgcagaccccagcagtgcctgtgaaagaacccccccccccaccccactccccaagaggcctggttcccactgtttcccaggccagagcccaaggacagggctgcctcattccaacccatggtggcactggcaccattagtaagcactttctaccagccaggcatgctcctaaatgcttctgaactggaccatccaaagttgtcactatcaattcccttttacacaaggggacagtgagacttctgaaggcagaccttgtccaacctcacagtgccagcatcgcccttggcgtgctagtggggttctgccctcttggctcggctccttcatggttgcctaaacttctgcgggcttctctccagagcactggccttgattttggggtgtgaaagagaaaacatttggtacccactcctattctttccagccatttgaggccacatcaagggtgagggacctcagagaccttctactttaatctccccatcttacagaggaggatactgaggcctccatatggaagggccttgcccacaatctcagagagtgttgctgatagagcaggggccaggctgcccacccagcttccagcccagggctctggccaccatcacaaatatggcaccttggttcccaggctccaaatgggaccccatcataatcagctctgaggagggatgtgagaaatagagaaatacactcactcatcaaaacccaaagaatggacttagaggcatgaagaacagcgaaagtgagacttttaataacggtcttgcaagatggagtgtctggtaggcaggcacacctggggcagtcacaacaggaatttatctcctagtgtgcaagtccctcccccagttccccattggtcgagtactatggggttacaatcttccctgacgtcgcctaagtttcattttccccgttataaggttataccccgctccccttcgatttccccacttaagtttcgatttcccaataacaaaactttcttccctttcatgggctgacccctcctctacattctgttcgcttattgtgtccttctaggtgcatgagccgtgtggtttgttacattcgcaggttggatgccagtacttagacttatcctgccttgaaaatggaccatttaaaatgttttctcaccaggatgcccaggcctttcccagatgcctgatcacacatcagactaacccagaagccacaggcctgggccctgccatccctttcccggagggttccccagtctgtttctcctggtggctccaggcagtgaggggtgccaggctggcccaagtaaggcagctgagtcccgtaccctgaggtgggtgagggctgaggtgccccctgtagcttgggggagggcatttctcaggcacctctgagagtcctcagactgtgcacctgcaggaagaaaacccaggcccacctctgcccttcagcccaggcctggccgaactctcctttgtgaccacacattgactctgctgtcccagctgctttcccacaggccccccgagctggacaacctgctcaggacccctccagccccaaggacattcaggattgacatctctggccttacgttaggacacatcctgactggacaagcctccgcctagataagcatctatgtccccaagacaggcatggagacaggtccctgtggcccctgtggttacttgatagcagtgaagccacttttgctaacttaagggatctccctccaccaggcccacacaccttggctttcattcaaattacttcctctttcccaagggcacagagctgctctctctactctgtggctcccccagaaaactcctactcacccggcagggcccagctcaaatgttcttgctactgagcagccttgcctgctctgtctgggtcagaggtcagcactcccctttctctgcagtgttaatgtcctggagttgaggttggtcctccgtgtctctgtcctgctggtggactggaggctcccagtctcctgcctcgctatttgttcagagccaggcatgtactcggaggggttcagtaacactcacccaaaggaagacacaaacaaccactgagcatctgccgcacaccagacagtggcacgtggggcaacatggaggctgccgagatgaaggaggcacagtttccgccctgcgcaggtcccctccttgtttcagcctagaatctttctaaattccctatttacttcctctaagactgactattcattctgctcatctttggacaatcttaaatgtgtttctgatcacatttttgttctttttcacaaacccaaatagctctgattttgtttctgtttcctctaaactagggtttctcaaactcagcactatggtatttggactggataattgtggtgggattgtcctgtgctgtgtaggatgtgagcagcatccctggcctctacccagtagatgccaatagcaactccccttagttacagctaccaagactgtttccagacatgccaaatgtcccctgaaatcgccctcagttgagaccaccattctaaactatcttactatgattccttccagccccaaatcagcctttccagccccaaagctttgtttcccttttcttctctttctatgccacattccttttcaatgaaggacctcctcctcgtcatgggaatgtattatttctgactaattatctgagctggtaggaaccttcctttggctccattaaaacaagagggaggtgggaacaatcaacatgacttaggtatctaagctattacaaaaggaaaatatgctcaggaaataacaggaatttgattgcagacagctcagagagttcgggattctggctctagctcagctagctcgctcccctggggctggcacatctgcgggcacctggcctgatcaccctgcctggccctgagcctgcctgtgtgcagggaagctcaaaacctttgcccttctggaacaagctggccattcacaaaccagactaaggctcctttcctgtgtgtcctgtgtgtgcatctggccccgccctgggcatcttgggagcgccaccatccttcctcctgttgaaaatccacctctcccctttgccttggatccttctctttctacagctcaaagaacctggcattgcacagcccaactctgtctttgtttttcttccagccccttcttccttgcctataaggtgttctactccagcatatgctaagtacaaccatgaagacccatgtgtgctcaaggacaggaactaggagtctgtcacctctctctgggcctttcctcattaccacacactgctccagtgacctcctttttccctccacccctccacagtcagaccacttgggttgtcctcacttcctcccccccagtcacccctcaatctctgcagggtttctgcctccagatgtcattgacactgctctcctcaaggtcaccaaggacattgctgttcctgagtataatgtccatgtcatcctcctctcccttgatcacccagtttctttcatcccgctgcctgctgctcctcttgggggcccctcacccactctcctgcttcccctgtctctccagctccatctccccggcctgacttcttggctgaaaggctgtgtcttcttggagccctgacctgggcctgcttcccctcccatgctctccccaggtatcttctccatctccaaggtgtcagttaccatcttgtgctgacgattcccaaatccatatccccacctgcctccccagagcttcagaactccggccagcacaccctgggcctgttagtgtcatgcacaactgtcgctgcttgctatgtgcttaccatggtgcacacctgcgttaaagacttgaccagggtgtctcattgcaacttcacaaccacaccttgaagccccccaagtgaatggcacccctggagcagttcagcatgacagccctggatcatatctccaaattcatagtataataggtaaactgaggctcaggcaagaaagtgagtgatctagcagtaacagccaggtggggctggctctgaagctggttttaccctcagtgctcaagggccagcccccagcagccaggagcacgttctcttcggacatttaccccaagcacatcggaaatatttctcccttctcccccaccacagttcaccaaagcagcagcccctctactcactgccccacaccctcatcctcagcacctgcacacccaggccaggggaagagatggggactgcaaatgtgcatggcagcccacagcaccaaaggacagtgcacgcccatggcatttcacattgactgccaactaagtgcttggcacaccatggttcatctgctctgaggcttgcgttattttgcagtttcacctctctgaatttgggatgtgtctcctaggcagccttgtggcttcatggcaatgtccatgtggcttattaaaccgtagtatatcttacagccagtagccactttagatttggtaaaatatgttacactgtctcatcagagcctcataacaagactctgaggtgggtgtcattatccccatttcacagctcaaaaaactgaggttcagagaatgtgttgctcaaggccacacagttaagaaggtgcagagcggggactaaaacccaggtctccttgctccctggccctgtacctcttctgagcacagtacaagggcatgggctgtcccacctactgttccaagttcctttcccaccccacactagccagcgccagccccacctaggggatggggctctgcttcctaccacccaccaccagggtcaatcaggatcagatgagttgcctctgctgctcctctgaactttggggctcagggcaaatgtctggggtgtagacaggccctgcgaggagggaggggcccaacactgcctgggctgtcgctgctgccctcagtgacagcaggcctggatccttccccctccagtacttcgtcttcgacttccatgtctctccggatgtcatgtttgacaagatcatcaagatttcggtgagtggggagcagcccctggcaggcagggccactccctcaaacttcacctttgtgcagacttgagaggggtcccctctgtctagacccatgataaagaggcagcgccgtgcctggacacacggctgggcaagtagggacaggctggattctggcccccacccacccctttcattggatgcctctgaatagtgcattcgcccgtacacagtggccagcaagaaactggcgtgggcaggaggagctgatgctgagcctcagtgagccaccccactctgccaaacgccctcccacttcaccacaaacctcgggtcccaccactgccccatggaaagcctcaccctcgctgggcctgacgggtgggctgtggttctgcctgaaaggtgattcactccaagaacctgctgcgcagtggcaccctggtgggctccttcaaaatggacgtgggaaccgtgtactcgcagccaggtgagtacctgcgcatggccagtcagtcgaggtgtgcatggctcagggagcgtggtgcacggggcccttcccactgtggcagttcctgggaaaaggctggcaaggaccacagtctggcgactgttagtacacacagccatctggcctgcggagaagtggcgcacacagtctgtacacaaatgcagtgagcaactgcgcacccagtctggtgggttctcactcataattaggtgagtaactctgcacagagcctggaaggagcttcatcacacgctctggagtgcatggcaggctggtgcatcactggccacaggcaggctgaccagtagtggtagaggatgcagtgagggagacccgtcacagcctgcagagaggctgcgcccagactcctgcctcctgggctggcacctgctgagcagaaaagaacccctttccacccctcacaggaccctgccgtccccttttacagttgaggctcagagccagggcttgccccagccacacagctggccgggggtgaagtcaggctgtgtgtccccagagcctcactgagccacactatccaatctgaacgcggtgatgctggtcaatgccagctgtagtgcggcggcctctgagggactctggtctctgaaaacacttcttacaagagccccaggcttttgggcagccatgtgtgctccgtggcatcctgtagggtaacagcaatggtgttggcaagggaaccccaaggggtggcccagagggcttgtgaggtgggccaggcagaggaagtgcctcagcctgccagatgacagctcaccacgtgggcaggttagggaccaccctgtgtccctgaagtgaatgcactgctcagagtgctgtaatgaccccattaggcgctttgacggtgagaacataatttcacccaattgtcacattggaccctcacaaaacagtaatgtaggcagcagcatttcttcccattttgcagatgagataaatgaggctaagagaaatgaaggggcttagagataccactaaactagtaggttgaacaaattggcgatcgcttgtggttcaacctaagagacgtccagctggtgcacattacaactatgacttagaccagggaatctgagtccaaaaccaagattatacacataaaaatcacaagatcatagaacactcaagctgcccaagaactgaaaaacatctagtccagcctctgtgaagataaactgaagcccaaggtgatgaaggggtttgtccaccatctaggagtagcacccctgtctccagctcccaggccagtgcctttgccaccaccccacacatgccatagccctcagcggagggcagccctgctgaccatcagtgccatggggagcagggaagagtcggcctcctgccatgttgctttccaggaagcatgcatagccgtggactacttgcttggaatgactggcatccctgaggataagctcctcccagggctgagcagtggccccggtaccactggcaggcctgaggccgagagccaagagaaagtcagggggtggagaaaaaggcggagattagtctaatatggacctctgggcttctgggtagtaaagtcctggtgaggaaaccaccagggcatcagtaagtgccagatgttgggctaagctcactgtcccagcaggcctcaccctcacgaccccatataggcatcattcccatttcaccataaggaaactgaggctcagcaggcttaaacagctggtccagggccacattgtgagtaagcggcagaaacaggatgtgggctgaggtctccacttgggtaacctagctggagatttgctgctcctgctgaatccagccctgagcctggtgctctcctgtccctgggagggcaccaggcaccctgtcccagggataggagagcctgaagtcacatgggtcctggagttgagacctaatgtctttactctgatatctccagtttggcctgaacttcttgatgagtcgttagttccagccagggcattgttggacagcatgctcccagagacactcctgggtgctgctgggaagctttgggtggtgtcgatatctcttggaactggaaggggtttcccgagagaccctcttctcaccctggcaggaccacattttgtcatttgtaccaccagatgcaacatcaggaaactgtttactgtttgctactctctgttgggggtgaggacgggccatacactcatcctcatagatcatagaggaagtcaggggcatacactcatcctcatagatcataaaggaggtctgggatgcagcaacttccccagctgggctacccttgactggcaggtgtcagccctaggctgaagggaggtgaaatgatgtttcaggctggtaagcatatagctcaggatctcatgtggtccttgtatctctagcctgagatcacacagtattaggactagaagggcctcagaagtcatcagtcaagtgttaacctgatgtagggacccccacagcaccatctctgattggtcctgtaaccttgcttagtcctcccagaaatggggcactcactacttcttattttagatatcttcactttctttaggtcatctcaaaatctgtcaccctgtaaccttcacccactttcacaggtctctctttcaggacaaaaagaaaaatagactttaaatttgaagataaattttacattcctcctgaatcgtattctctttctttgctaaatgtccccaattcatctaaccatgcacacctctatacatctacccctgtatccatccatccactcacccacccatctacaaatccatccacccacctgtccacagatccacccactcatccatgtatccatccattcacccaccaatccatatatccattggtccacccacccacccatccatgaatccatccacccacccacccgcctgtctacagatccacccactcacccatatatccatccatccacccacccacccattgatatatctacccacccatctatccacagatccatccacctacccacccatccacagatccacccacccatatatccacccatccacccacccatccatatatctacccacccacctgtccacatgttaatggctccttctatccagtaatccattcaccatctgtccgtctatctctcagccggccaggcagctcaccacccctccctctgcccatttatgcacccattcattgagctttctgtccatctcctcatccgacacacatctgctctggtaagacctgaagctcctgagattcctgggacatggcccctccctggaggcctgccagcctggctgaggttctccagtgactcctcatccacgtgccttcctgccctctcaccttgcttgtccctctcttcagactctactgtggcattatcttttctgagacacaggtggcctggctattcccagaaaggccaacctctgcacacagcccctaacatctccgggagcccaccagggccacaggcttgcaggacgcaggcctgggctacggtagaaggtggaagaggagggagtgaaggagggaggtgctgagtccctgagagttcagtgcccacctaacatcccgggaagcagattcctaaggcacagtgatgcgcttccctttgcttgcccactgggcttaaagtaaacctgaaggggcaaatccttcctaaagcgcctccttccctgacatccgtcctttcctccacacagtcataggtcatgggacactgggatgagactgacaatccctgtctttaggagactctcagtctaaaatcagagccaaacaatacccagatcagcacagtgagatgggaggtgtgcatggagagcacagagaacaaacactaaagagcccaggatcaactcttccgaggaagtcagggagggctgcatggagaaggagaaacttgagcaaaatgagtagaagtttacaaattgaatagggagaaagacaggtggaggtggagagaacaggaatgagggcattccaagctcaaagagcagcagatgcaaaggcatggaggtataaaagggcatataaaaccgcaacacctgttcagcaaggaggaacacagggctgggtgggctcagcagagtgagtcagggagcactaaatcaggagcctgcaggccatgccttttgtcttcaccccaaggcactgggaagccccagaggggctgaagatggggagcaggagcatgagcctccacctgggaaggccctgtgtgcagctgtgtccttcacagctatgtgaaggctggctgactggggtggggccatagaagaggccacaggcagaaaaacccaattaggaggaggctgtcgtgcttccaagtcacaccactgatgggatatatgtccatgggcaggctgtgcacccactgccccagctccagaggacctcagactctatcacaccctgggctagggacaggcagagctgtggccccaggtcccgggactctagggaccaagacagcatttggttctgccaccccttggcctgccctgagcactgggagatgctctgggtgggggcgtctggtgcagtgcccacccctcatcattgcagagcaccagttccatcacaagtgggccatcctgtctgaccccgatgacatctcctcggggctgaagggctacgtgaagtgtgacgttgccgtggtgggcaaaggggacaacatcaagacgccccacaaggccaatgagaccgacgaagatgacattgaggggtgaggcccagctaccccagcccctggagtctgagccagcccttccttcccccagggagcccccggtgagggtttgctcagagcacctgccacccgtctccctcaccctgctctcactcactctcccaagcagccccactcttccgaggcagggcaggggcagggggtgatggaggatggctgagaataacagtcctttgacatcctttctgccagtgagaaacgggttgggaagagtcgatgctggcagaccagagccagcagctgctgggtcctgagtatagcagcaggaagtgctgggagagccaaggtttcttctggtgtgccaattccaggcagctgatagcagctgttgagaaatattctgtgaccttgtctggagtcagtgggtaaaagtgctgggatcaatgaatcctgtcttttgtgagctgggggagagagagtggctactgtgaagtttttgtctacgaaacaaaagataaggcacaaaactataaaacactgacaataatactaagatcatatcccaatgtacaatctacaaagcactcatatgttttagcgtgcttgagccgatcatattcttgggaggtgggtattattacagccacctcagcagtgaggaaacggcagctcagtgagatgggaagatttgcccagaatcccacaaggggcaagttccatgaacgcaagtgtctaatcctagccttgctccctcagctgtcccttagagactgtgccaggacccaggagtgtgtagatgccaggatgggggttggggacctggacctggtgaccatggccctggctgtatgtgctggcaggaacttgctgctccccgagggggtgccccccgaacgccagtgggcacggttctacgtgaaaatttaccgagcagaggggctgccccgtatgaacacaagcctcatggccaatgtaaagaaggctttcatcggtgaaaacaaggacctcgtggacccctacgtgcaagtcttctttgctggccagaaggtactggggtatgaggtacaggaggctggggctgggtgacaggtatcacaagggcaggctgatgggtgtggggcctggggcagctgggcaggtaagacaaggctggaaatcatgttggccagggacggacttagaggatcctcactgcctcctggagtccttagactgagagctgcgcagggggcatgagagggaggagaggctgggggtgtgggaagagtgaagacaagtccacacacaggcacgcacacacacatgcacccactcacacacgcacgcataccaactcacacacgcagacacgcacccactcacccgtgcacatgtgcacccacgaatacacacacacatgcacccactcacacacgcacacacacccactcacacatgcacccactcacacgcacacacacccattcacacatgcacacatgcacccactcacacacgcacgcatacccactcacccatgcacacattcacccacgaatacatacacacatgcacccactcacacgcacacatgcacccattaacacacgcacacatgcacccactcacacacgcacacatgcatccgctcacgcacacatgcacccactcacgcacacatgcacccactcatacacacacatgcatccactcacacatgcacgtgcacccactcacacatgcacccactcacacacgcacacatgcatctgctcacgcacacatgcacccgctcacgcacacatgcacccactcacgcacacatgcacccactcacacatgcacgcacacccactcacacatgcacacatgcacccactcacacacgcacacatgcgcccactcacacacacacacgcacccactcacacacacatgccacgccctcacccgtgctcccccttccaccagggcaagacttcagtgcagaagagcagctatgagcccctgtggaatgagcaggtcatctttacagacctcttccccccactctgcaaacgcatgaaggtgcagatccgagactcggacaaggtcaacgacgtggccatcggcacccacttcattgacctgcgcaagatttctaatgatggagacaaaggtcagcagcgggagacccggtgtgctggggggcagggagtggcctgaagggaaggaataggtgagatcccctctcttcacaccaccgtcatcagctctggacctcagcctcacaggcgcttccagggccttgccagcagcccctgcctcagggggagggtgaggatttgtggctcaggtcggctcagagctggcctgagcccagctgactggatttgtcagctagtagttgtgtgacctgttttcccatttgtaaagtgaaaataataatgattatatgatatgataattatagtatgatatgcacattatagcagtgtatatactgcatttgtatataattactgtgtgtgtatatatatatatatgatacctaatagtagtgcctatctgcagacttgcagggattgaccacctcctaggatccctgccttgtgctgggttccaaggacatagagtgagataagaatctattcgtggatcaaagtgctcactgtgtattgaggagatagatgtgctaccaaatggtcaaaacataaggcagaagacacaaaaggccacatgttgtctgatccatgtgtgtgaaacatccggaaaatctatagagacagaaagtagattgccggtttccaggtgctaaagggaggggattgggactaactgctaaataggtgcagagtttcttttgagggggtggaactgctctggaagtagatgatggtttataacatagtgaatatacgaaaaaccactgaaatgtacactttaaaagggtgaattttatgtcatgtgaagtatatctaaatttttaaaatgctacaagtgtgtttttttaaaaaaggcagaataaaaaggaaatgaaccaaaaaaactggatcatgcgacccctgtcagaggcctgacaaaccttagccataagagaagggacttgtgcctaggaattgggaaggcttcgtgaggaagcagcatttcacaggcagagatggagagggagggccttcagcgaggaggggaggggtctgcagcagcagggtcaccgtggtgggacagagctgcaaaaatggcacagggcccaaggtcatgctggggacttggaaggactggctctgtcctacaagtagactgttgacaattcctgctctaagttccaggaagcagggagctagactttgccttcccactgcttccagctcaggccctcgcagggaagaaatagacccaagagagtgctccaccccagcgcagtgtgagaaggctgccccacacctgaatggcacacatgaagttctcagctcagcacccaggagctggaggccagggacccccaaaagaggcccctcttccccagggaaactggatgtgacgcggccccctcatttttcttcccactgccacaggcttcctgcccacactgggcccagcctgggtgaacatgtacggctccacacgtaactacacgctgctggacgagcatcaggacctgaatgagggcctgggggagggtgtgtccttccgggcccggctcctgctgggcctggccgtggagatcctagacacctccaaccctgagctcaccagctccacagaggtgcaggtggagcaggccacgcccatctcggaggtgagaccccaggcactgtgctgtcccccagggcctccagctcagcccccttctccctgagtcacctgggtcccaggctttgcctgttgctgccctgtctacctgaggagtcagacctcaggataaggtttctccccaggaagcagaggcccccactcagccccccaacaggactctgccctcgtccactgcctgcctgtgctctgtctcacaacggccgccaggtctcacgatggtgcctcccctctgcccctcttcccagccacggctgtccctgtggtgtccgcagccagccctgcttccatggatatccaggctggggggccgttggggtgtgggcttcctggccccaaagccgggggggatgcccccaccatccacccccagggcctgtctgtgagacggaaggaggcctggcccccgacctgccacccttactcaagctcaggaatgctttgaactgcctccccacagagctgtgcaggtaaaatggaagaattctttctctttggagccttcctggaggcctcaatgatcgaccggagaaacggagacaagcccatcacctttgaggtcaccataggtgagtgctgggcccacagcaggcttcaggcctaggtgagcgctggccccacgggaggcttcaggcctaggtgagtgctgggcccacgggggcttcaggcctaggtgagtgctgggcccacagcaggcttcaggcctaggctgcaggtggtaagtgtgaggctctgcacctcagccctgtcctcactcttgtagggaacgttgacccctttcccccgagaggcctcaagcccccacaaaacacctttgtgtgtgcatggggtggaccacgccccataaaggggccaaccctcagctccacctacagggtgaggctgtgtttgggacctggggcagagggcagggagaagcccttcccggagctggagaggagagagtgggaactcaggccacagcctgggccagggctgggcctcgcactcaggcgtcatgaggactccctgactctcagcggagtggggacacggggtaatgctctctggctaatgatgtgtcacatctgagccccattccctgactctccctctcccctttcccaaacccaaggcagcaccggattggacggtgggaggggcctggtggggaatgcactctaggccttctgggcccattctgctccaggcaactatgggaacgaagctgatggcctgtcccggccccagcggcctcggccccggaaggagccggggggtgaggaagaagtagacctgattcagaacgcaagtgatgacgaggccggtgatgccggggacctggcctcagtctcctccactccaccaatgcggccccaggtcaccgacaggtgggcccagcctcccatcctcctgtggcctggccctcccacctccctgggcccccaagacctcacctcccgcctctgcccaccccaggaactacttccatctgccctacctggagcgaaagccctgcatctacatcaagagctggtggccggaccagcgccgccgcctctacaatgccaacatcatggaccacattgctgacaagctggtcagggccaggccaggggccagcaggggtggggtcctgggggagacggcgctgtcagagggccttccctggaacacacaaagctggtctgcccagggggctgcaggaacggccccagcaggacctctgttcccatcctcagccccaggtcccaggcacagacaagggcaggagccacctctagtcactgcagcctccagcgaaccctggggcaggagtgttgggttccctgatttttccagaaatcttaaaagcaaggctagggagacaggtgtggtggctcacgcctgtaatcccaacactttgggaggccaaggcaggtggatcacctgaggtcaggagttcgagaccatcctggccaacatagtgaaatgccatctctactaaaaatgcaaaaattagcggggcttggtggcgggcacctgtaatcccagctattcgggaggctgaagcaggagaatcgcttgaacccgtgaggcggagtttgcagtgagccgagatggcgccactgcactccagcctgggcaaccgagcaaaacttcatctcaaaaaataaaataaaataaaacaaaataaaaaagcaaggctagggaagggaaatggggaaaagggagaagcgagcagtgtctgaagctcaggagctgccccctcctcctctgcccacccctctccccccttgagccatgggcactgactgggtgaggagtgcagctgttggcgtgagacctccttctccccagcctgggggagcagggaccagcagataatcccactcttccctgagctgttgctgttccctgttgaagttccctgaagctcagccagctcatattttataaaaatgaattaaaacctccaaaaaaatcaaggctaatatgaggtctgctcccagccccctcccaatgtcctccttgtcatccctgtcttgtgactataaccacaattaaagcccatagcctttgcagtgtgacctgggtctgcagttatctgcaaggcttccccctaaggagctggggtacaagctgacctgtgtttcctgtgggacctgtgtctcacagccctcccagtgctctcagagccagagccactccctcttcccccaggcatctgttcccatcccctgccacaggccccagcattctggagtgacgtcaggatcttggcacatccagtcctagggtttccctctgtctctggccagccctgagccccctagccctgagttctgcccaggccctgtgagctcaccagagccacagactcacagcccagaggtggcttcttccttcaggaactgaagaacccatgaacaccaacatctccaggttctgagaacagaacctgggaaattgatgacttcctcatgatcaccgatactcaggatggccctagcgagagctcccagatcatgaggtccctcactcccctgatcaacggggaggaggcatttggggaggctggggaggcggggctgtggcccagcatcacccacactcctgattcacaggaagaaggcctgaacgacgtacaggagatgatcaaaacggagaagtcctaccctgagcgtcgcctgcggggcgtcctggaggagctgagctgtggctgctggtgagaagggaggggcggcaggtggggggaggatgaggcggaactggacaaaggggaccctgccagggctgggcagatgaggaagaaactacagagcccctgctggtcaggctcgctaaaccccggctccccctaccctcagccgcttcctctccctcgctgacaaggaccagggccactcatcccgcaccagacttgaccgggagcgcctcaagtcctgcatgagggagctggtgaggaccgactggacagcggggactggagggagggcctggctgtgagaaggtgtcacaaccccctttgtcatggcctgagctgtcccccagttgctgggttcactgacaccccctccttcgcaggaaaacatggggcagcaggccaggacgctgcgggcccaggtgaagcggcacacggtgcgggacaagctgaggctgtgccagaacttcctgcagaagctgcgcttcctggcggacgaggtgcggcaaaaggggtcggggctttgcctcatccagggctggctctctggggcccctcaggctcagggggctcagtcaggaggctggacccccttacccgctgcccctggccaccccccaacccccagccccagcacagcgttcccgacatcttcatctggatgatgagcaacaacaagcgtgtcgcctatgcccgtgtgccctccaaggacctgctcttctccatcgtggaggaggagaccggcaaggactgcgccaaggtcaagacgctcttcctcaaggtgctggagggagcaggatggatgggggcctgggtcctttcaggggagcagcagcccccacctggggctggacggcctgagtgacagggtggggccttcaagcagcaggtgctcagagaagagccaagaatgggaaggaggtgggggaaggggtggggaaggaggtgggggaaggggtggggaagggggcatgacggccccctgcccatccccctgcctccaccggaccccagcccagcgggatggctgtgaatgggcagggcagctctgaccagggcctctgccagcccctgccccttccccaccccttgggccctggcagccgtcaggctcctggtgaccccatgcccgcccccagttgccagggaagcggggcttcggctcggcaggctggacagtgcaggccaaggtggagctctacctgtggctgggcctcagcaaacagcgcaaggagttcctgtgcggcctgccctgtggcttccaggaggtcaaggcagcccagggcctgggcctgcatgccttcccacccgtcagcctggtctacaccagtgagtgaggacccctcactcgaagcctcacctgggagggggctggaggggctgcccatcccggaacctcaggctgcccttccccacagagaagcaggcgttccagctccgagcgcacatgtaccaggcccgcagcctctttgccgccgacagcagcggactctcagacccctttgcccgcgtcttcttcatcaatcagagtcagtgcacagaggtgagggcctgggaggagggagtggctctggctttgagagcacaggaagcctgtgagcctgtggggactggagcctgtggggcctgtgagcctgtggggcctggagccacaggtcagccagtgccccggtttctcaggggaagccctgcagataactgcagcagacgcgggtcacactggaaaggctatgggctttagctgtggttatattcacaagacagggatgacaaggaggacattggcagggggcttgggccaaacctcttattagccttgattttaagatttctggaagaatcaagacacctgtcactcctgcccccaggttccgtggaagctgagtgagtaggggtggcttctgtttgtgcatctgcccaccctctgtcacttgtcccctgtctccccatcccatgctgcaggtgctgaatgagaccctgtgtcccacctgggaccagatgctggtgttcgacaacctggagctctatggtgaagctcatgagctgagggacgatccgcccatcattgtcattgaaatctatgaccaggattccatggtatgggtgggctctggtgccagggaccccagcagcaccacacctggcccttgttccctgcactccacctgcactgaggctgtgccctcacctccgccacccacctgcagagctccttggccaggtgctggctgggaagctgggagtgggggctgacatctagctcctcctgcctgcttgcggcagcctgaccccttcccgggccaggacatcctcacctcctgtcacctacagactgagccctgaaggtgtgccagcaagtcctgctgtcactagcctccccaccccagggctccctgacccctgccctcacctaccacaaccagtaacagccttgccgtcctctgtggaggttctggagcagggagtaagggattggggtgacccccgagagttagcgagccaccttctcacataccacctcagctgctgaggtgcccagatagccctggactagaggtaggaggacctcatgtctagtcctgagctgggcatctgccatttactgacggcttggccttgaacaagtctttggtgggccctgagacttggtttcctcatctgtaaaatggggtgatcacacctgtcccttacaacaactcatggggctgtggtaaggaccaaacgagatcacaggtgtggacagcaagcaccaagaggcttctgggttgtctgttgcgtcagggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcaggtgggactgcagggaagaggggctgaggcctgggaactggaggctgggagttggggcctagggctgggggctggagcctgaaggctggggcctggggtctcgggcctgaagtctggggcctggggtctggggcctgggggtggggcctgggggctggaggctggggcctggggtctggggcctgggggctggggcctggggctgggggctggggctgagggctggggcctggggcctgaggggttagggcctgggcgttagggcctgggggttggggcctggagctggggcctgggggcttgggcctaggggcctctctcctacccatcctgaccaaagctgggggcgtggtccttagggggtttccctgtctccccagatcatggcaaacaactcatggggaaagagaccctgtccctgggctccccagtgtgtgacctgtgacccccattccccagattggaccagcagggaaggctgacctgccccccatcaatggcccggtggacgtggaccgaggtcccatcatgcctgtgcccatgggcatccggcccgtgctcagcaagtaccgagtggaggtgcgagggctctgtgtggcccttcccttttggatgaggagtctgaggacccaggaggggaagtggcttgtcatccccctcccaccaccatcaccaggagccagcagcagacccaggctcctgccccagcccagggcctgcccccatctgcaccaagtcgcactcccatgtcccaggaccatgcccagccctcctgtctgcacccctgactctgcaccccttctccgggcagccccaccctcatccctggagaacgcctgcccctcctctgctctcctggccctgctcccaccctttgaaatctggggtgaactactgcccatcccactgcccagttccttcttggatggtccagcacccccatggctggctcccttgactaaggggctctcttctctgcacccaccccccaacctctcccaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggtgagtgcaggccctggcggacggaggacgtcctgtgtggctccactcagccagccggcttcctctgccccttcttggaggctcaggctcctgtcgccaacaccccaggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacgggtatggccacatccaccctgccaccaagcctggctccacgccccccagggaagggctccaggtctccgcccagtccaagccgcgaccagagtttgctccttggggccgagggggtgggcatagacgaaggtcaccctggtggccaaggaaggctgcccaaggtgacgccagctctacagccagagagggcagaactggagacagcctgggggggcctgagggcagaaagccccttgcgctggttgatggagaagacccaggcctccccgccacctccctcccgccggcctccgcagcttccccttatctcgggctctcttcttccctcctcatgcccatattttctcccttgactggctgtccccctctccctcagaaagttccagaatcagctttagttctccgcaccttcctgccccgccaatctcactgttcctcttgctccttcctctgcctgtctgtccatctatccatctgtccagtctggcttctccgacgctgccgtgtgctgtgcaatgggggctcctcctctcactccacaggggaggttgtggtgactatggagccagaggtacccatcaagaaactggagaccatggtgaagctggacgcggtaaggcgggtggggtcagccccctgctggctgggaacatgcaactccgtgtgacacatcctgtgaaccagactatctgccccgagagaaaaggacactaagagcctcctttggcatgtgactgtcgggggctgaacttgattgtgtgtccaaacagctccctcctaatactatcctggaatgcacacgcgtgcgtgtggtgtgtaaatgtgcatgtgtgtgcgcatgtgtgtggtgtgcatatgtgcatgtgtgtgtgcatgcatgtgatgtatgtgcatttgtgcgttcatgcatatgtgtggtgtgcatatgtgcatcgtgcatgtatgcatgtggtgtatgtgcatatgtgcgtgcatgcgtgcatgtggtgtgtatgtgcatgtgtgtgtgcatgtatgtggggtatgtgcatatgcacgtgcgtgcgtgtggtgtgcatatgtgcatgcatgtgtggtgtatgtgcatatgcacgtgcatgcatgcatgtggtatgagcatgtgcatgtatgtgtgcacgcatatggtgtgcatacgtgcatgtgtgcatgtggtgtgtgcatatgtgcgtgcatgtggtgtgtaaatgcatatgtgcatgtgtgcagtgtgcatgcatgcgggtggtaggtaaatgtgcatgagtgtggtatatatgcatatatgtgtgcatgtgtgcttgtggtgtgcatgtgtgcatgaggtatgtaaatgtgcatgtgtgcatgtggtgtatgtgcatatatgtgtgcatgcatgcttgcggtgtgcgtatgtgcacatgcgtgcatacatgtgggtgtgtgcatgtgcactggcatgtggtatgtgtgtatgagagacagagtgagccatcacagtttattataatcacctgctataatttttactccaacaaatgacaccataggtaatgattccttatgagatcatcagtgtcctttccaaagagtccctggttttccatcccggccattcacaaatgacacttccccagcctgggtcggaggaggatttccaggtggaagctccttattcctcctggctttgggcctaggactgttcatctgccagagagagaactgccacctgggggttgggtgtggaagtggcgtacaagctgtagaccctacagggaagggcagaacgtgggccagcctggaacacagcccactgttcctttggccacccaaagaaacatcctcactcagaccctttgcagactcaccagtcagagtgctcttattaatgcaaagttggccttgcgggcacaggggctgccagcacacagtaatttctgtcttggctcctccacacaccctgtgctaggccactgcctgccactccaggccccagtggctgattctgtccctgtctccttggttcctctgcagacttctgaagctgttgtcaaggtggatgtggtgagtgtgggggccatgcaggggctctggggtgagagggtcctttattggcaatgatgtcaggccaaagggtccagcatcagggacagagccagccccagcccccgcatgcttgggccagcacacctcccctaagatgcagtggaaaagagctgggtgagtgcaggactcggtgccagtcctgcttgggcgagtggatcacactggcaggtcacaacactctgtggcctgtggcaccttctccataaaataaggccctgccccttggacatgggtggccccacagggcctcatggagcccaaggcttcctgctgacagatggcggaatgggtggaggctctcgggattgtccaggcaggaggagtccatgtaggactctggacctggccaacctgcaggctgaggaggagaaggagaagaagaagaagaagaagggcactgcggaggagccagaggaggaggagccagacgagagcatgctggactggtggtccaagtactttgcctccattgacaccatgaaggaggtgagacctcgggtagggtgaggggaggtgacccctccacactcagaccctcctgtccagcttctttcccacggcccccaagagctggatcccacctccattcatgtgagtttgggatggctttgtctcacatccttgaaatcctagctcagaactcaccttccaagatgatggtcccatctaccttccctgcttggttttcttttgtcctcattgactcattccacaaatgcctcttgggtatatgcgatgagccaggctccatactaggtgctatgggagccaaaagatgccacacctgccctgatgggcctccggtttactgggcaaaatggacatgtaaacagagacttagagaggactatgtgataacaaaggcaaatcatggcttgggggaatcagggaaggcgtctcagaggaggtgacctttgtggaaaaggagaaacatgttctcagaggccataagggaacaactgcttatcagtagtccttacgactcttcttcatactgttttattttacacatcttggtcatcggcacgtgaatgattcttcccctattacacatatgtgggttccatctgtttggccagaaacagttccagaaagcgcatttctctgctttcttgtttgtgtcctctccacgctgcctacctagctcagggtgctctgactggccacctgaccaggagggacacatgcctgcagttgtgtttcctcagtggggccagagctgatccagccacatcctctcccaggccctttctgtgacccaagctaggtgtgatatttattagagcacacattaagctgctgtagcaagttagagtgaagtgaacaagacagcggtttatttctcacataacatctcagagagtgggggttaggctggtatggtggctcagtggtgtcaaggactaagatcctgacctcttgtttgtcacatctgtagggttggaggtgactcaacatcgtgttctaattcaagtgcacaggaagggttaaagaggagatgaggcatatgcttttctttttcagggcccaatccagaagctgcacatatgacttccactcacattgaccagaatctagtcccttagctacacttatctgcaaaggaggctgggaaatgtaatctttagcaaggtggctgtgtgctcagcaaaacttgtaaaaataggagaacagatcattgaggacaactggtagtctcgtctcccaccatcaagttggccaggctggagctccaagaggctgcctgttgccgtctctactcctgcaattttcacagactgccaccaggtggcggtggcgacttagttgaaacctggtttctagtttgtagtaagatttattctcgtttccagtaagatggggtgtgctgagtgaaagaaaatatagtacattttcttactgttatacttttctacattaaaacaattaatttattaatatcactaaaagcaacattaaaatgcactgtacttttttaagtagaaaatgtaaatatttattgcaaggtgttatttcttttttttttaaattatactttaagttctagggtacatgtgcacaatgtgcaggtttgttacatatgtatgcatgtgccatgttggtgtgctacacccattaactcgtcatttacagtgggtattgctcctaatgctatccctcccctctcccccaacaccaccacaggccccggtgtgtgatgttcccctcccttgtgtccaagtgttctcattgttcagttccctcccatgagtgagaacatgcagtgtttggttttctgtccttgtgacagtttcttcagaatgatggtttccggcttcatccatgtccctgcaaaggacatgaactcatccttttttatggctgcatagtattccatggtgtatatgtgccacagatgcataaacccctaagtaccactagtcacactgtacacattataaactttttttgacccacttaagcagagaacatggtggatttgaaatgcagtagggaagattttctacttctagtgcattaagactggtctgggcccacagtttggggtcaacagactcctccccaggaaacccaccttctgtccttttcatctcatcttttggcagcaacttcgacaacaagagccctctggaattgacttggaggagaaggaggaagtggacaataccgagggtgagccctggaacctggaactctgcctcctcctccccacccctgggtggtcagctctcctgcccacctcatcacctgcttctcttttccctcctgccagccctcccagccttagtagccagggaagcagcatcagtaatccgtgggcagtactgggcaggctaaggcccttgtccagggaggcttttactctgaccagttcagcgcccacagtgatgggcagacatttagagccacggaacatcagagctggaagggacctcagagctcattccatccagcattttccagactcttttccatgaagaaaattgatggatgttctagaaggaacaaattagttttgatcaaattagtttaggaaaagctgattgaaacagcttgttttggtgcaggacttttcataccctttactgtgcaaatgttattatacatctctaaaaggaagacacagtataaaatatttccccagcttattggatcacagtactctttcttctaaagcatgccagcagcatctgcaccaggtgctccactgaatgaggtttgggaaatgctaatacagagtgttattattatggacaagaagagggaagctagtgaggaaagtgagtgggcaaggaactgcgcagcaacaggcctccacccccaaacccatgctccttcctgcccctctcttccaaagggcatgaagacggtcttcagacaccttcccgggcataaactcactggggccccagcacctccatgaggcgggcatgctagggagtattatctgcatttgacagcacatggacatccgagagttaagttagtaaagcaaattagcgacagagctgggtctcgaatccaggccttcctgctctgctcatttctgctccacctccttttctgcttctggccaggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtgagagcctaggagcagacccttctagggtgtgcgggggcgggaagagggggcgcagtgatcctgcaggtggggcaggacaaaagccagagaccaggcagccgccccctaacagcctggtctggctcaggtataccccaaagagctggagtccgagtttgataactttgaggactggctgcacactttcaacttgcttcggggcaagaccggggatgatgaggatggctccaccgaggaggagcgcattgtgggacgcttcaaggtcaggccaggagcacgggcccagcctgagcacccgccagcccttgccccaccacaggttctcccactcacctcccaccgctgccccggccactccctccagaagccctggactctcccatgactcagcagttaaagggtgaaggccctgccacatcagggtccagccctcccggtgctgttagctattttgaatgccacccttgccaggcaaacctacaccctgacccacatttgtcttgcccagggctccctctgcgtgtacaaagtgccactcccagaggacgtgtcccgggaagccggctacgactccacctacggcatgttccagggcatcccgagcaatgagcccatcaatgtgctggtccgagtctatgtggtccgggtgagactcccgttgctttccctccttgcaagtctcctcatcctcccatctgggagagaccaaagaagctgcatactggccaggtgcaatggcttacgcctgtaatcccagcactttgggaggccaaggcaggaggatcacctgaggtcaggagttcgagaccagcctggccaacatggttaaaccccatctctactaaaaatacaaaaattagccaggcacagtgccacacacctgtaatcccagctactgaggaggctgaggcaggaaaatcgcttgaacctgggaggtggagcttgcagtgagctgagatcacatcattgcactccagcctgggagacagagtgagactctgtctcaaagaaaaaaaaaaaaagaagaagaagctgcatactgacagccccagactgggaggcaccagggagatcgtttggtctagtctttatcttttctagaggaagaagtcaacgcccagagaggggtagccacttgcctagggtcacacagcaagcctcctgaggggtccagtgctcctgcccctgcccttcactgtcataggaccctcaggcagcctggcaggggcactgaagatgagcagggcatgggagcctgctcaggcagcccttctccccattccaggccacggacctgcaccctgccgacatcaacggcaaagctgacccctacatcgccatccggctaggcaagactgacatccgcgacaaggagaactacatctccaagcagctcaaccctgtctttgggaagtaaggcttcttggtgccctcccctgccacaccccgacttctccaacccagaacacctcccaccctagccaatccttaagcccttctcctaactccaccccaccaggtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgctcagacctactccacgtatgtggggcatggggcagagagcgggggcagtgtgcctgctttgcctccactctaaaatgagattcagatcctggtgatttgagaggttagacattgtggtttctgtcccaggccaggcctctgcccctacagtccctgggcacagtcttcaggggacaggactgcagatcccaaaacaaggagagggacagtggattccaggacagaggaggcaggacgaggagagacaagtgggctagggaaggtgggggctagcagaggaggacagaaagagtcccctggggatctgggccagctctgccacttataggctgtgtgaccctggccaagtcccttcacctctctggttttcagtttcctcatgggagtctctgaggttccagaggagtgggcacagtgaggggatgcggtggggctaggctggggacactgatacgtggtccaaggcccagggcaggagggttcagcctccagcggccctagtgtctcaggtgagcctgggacccagggcaggaggaatcaggctcacttgctgatgagggcaacagccaactttagagaactggccacgaccagctgtcatccaggatggcttagtcccacccagcccctccaagcctgtgtgtcccctcccacagacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtaatggggcactggatgcagccgcctgccccctctccagggggtttcagaggccaggaggggcccacacttccctggggaacctcacagcctagcctggggtgtcctcagcctaaacctggtcttagtgaccctctgctcatcaccccagagccccgttcctgtctgcccagcctctgtgcttccacccctcctacagggcagccccacctgctttctctctgtccaaatcccagtgaggtagagaggttatctgcatccctttctgcagataaacaaaccaagatcctacttctagtgactcgcccaaggtcatgtggctctttagaggcagagcgagggcatcggcccaggtccgtctggctctaatccttaaactctccttacttctctgtccatgaggcacttcccagagaagcagagaattgggaggtgtctgtgctggtatctgatcactttcaggtgctgggacaggaagtggattttccctccctgacccttctctcagcccagcagggctctccagtcaacttccccaagcagaggaccaagggcacagacctctcttggccctgtggggcagctgagaccctgggcaagccacttctccttctgtgcctcagtttccccaacagtgaaaatgaggtggggtagataggtgatggtgtaggggcttctttgtgctcctgagtccctagtcccagcaaaggcctcctggttctgctgagccatgtgtgcagctgagccgccggcacccacaggtcagaggaagcccacagacgagcatgtggcgctgttggccctgaggcactgggaggacaccccccgcgcaggctgccgcctggtgccagagcacgtggagacgaggccgctgctcaaccccgataagccgggcatcgagcaggtgacacttgcatggccaagactggggttcttgggtattggggaccagggatccccaacctgaatcagtaaaggtagaagccaggcctcacgctgtccgctgcattccagaaagcctggcaggcaccttcccaccaaggcccctcagggtaacttgaatggcaagggtattcgctttgagtgagaattacatcagctcaggcagagacctgggttgtctccctcagaagctgtgattggctattggtgacatcataggaattcctggcatccaaagatggaaactgatgaactgggtccttgacagaacaaaggttaggagggagaggagagctgatcttcctgggcagagggagaaggccctgggagatctgccacaaccctcttcctcagggccgcctggagctgtgggtggacatgttccccatggacatgccagcccctgggacgcctctggacatctcacctcggaagcccaagaagtgagcggcctggggcccagcgctactcccttccggcccaccccacccacttcccaccacggcccaacccttcctgcgagggactcaggtccagatggccttggccagttggcatccctggggcctgggtgtggccactgggccttataggggagaaactgaccaaccaatcgatagagtttagggcctgccctggagagtccccacgtgctaaggcaggacaacgccttccaccctgcatcagtgagcgagacaagccccacacagcacactctgatgcattgtatctacacggtcgacgcgcccatacacatgcatctcatgcacacacacacacagcatagcactcccacggacacccacacacatgcccacactgacacactccttcacaacacacagaacccctgggagccggccctgtgtcatcctcacatccaggctagtgtgatgttccgccaagttttctttggagtgcctgccagtgatgaatccaggagtgagtgcctggaagaggcaggaggtggtagagtgaaaagaacccgggtttcccatccataaagcagcaggttcgagtccagctgtcagacagtgactggattcagggccagcttcagggatggaggaagccacacagggtcccactcttgtttccatgctcctatgttgccatcttgaaattctttatgacaagtgaccctgcatttccatttggcgctggccccagcaaatcatgcagccaattctgccaggaatgtcctggaaacctgaggccgtgagtcagctgttccagggcctgtcattagggggcacccaactcactgggccactctgggctcacagccctgtctgcaatcccaggagagccatgctcagatcaatttttagtgaatgactcagcctcactcttaatgattgaaatgaactacatcattcataattacaattaaaccttgaggggaaaattctctttggggacagggacatacagcttccatgggcttccattgctggctactgggcttaaatgcagacttctcttggaactagcatctgagacagagggtggcttcctcccctcaccccacccccaccgcccacagccaggtgcctggtgggccttctcactcatgcctctgctcccccaaccccaaaccactcctccagccccagcctggcccaggccccgtgctgaccccaagtccccagggcttctctccgcctgccccatcccagccctggcaccctggcataacccccacctggggctgctaaccagccttctctccctgggcccaggtacgagctgcgggtcatcatctggaacacagatgaggtggtcttggaggacgacgacttcttcacaggggagaagtccagtgacatcttcgtgagggggtgggtgagcagtccctgcatgggagggactgagctgagtggggcttgcttcctgggagggcaggagaggaggcagagggaaggtggctgtgggtgggagaggccccaccggcctggctgcgggtctggagatgtggcgcccacaggtggctgaagggccagcaggaggacaagcaggacacagacgtccactaccactccctcactggggagggcaacttcaactggcgctacctgttccccttcgactacctggcggcggaggagaagatcgtcatctccaagaaggagtccatgttctcctgggacgagaccgagtacaagatccccgcacggctcaccctgcagatctgggatgcggaccacttctccgctgacgacttcctgggtgcagagcagggcagggatgggggttcaggatccagaactgagaagaggcaggggccgggttggcagggacagggagagccctgccttggggagacaaggggtcattgcttccagtccgtcagagccaggggtgtccgacggggttccgcccccaaggacccacctaaccgtccctaggcagatgttctcagtgtcataaccaggctgacaacaagctttggacacaccaaggagggggcagtcagtgatgatgggggaggggagaggctccgtaagggagtcgggaaacctccctgggcctcaggttgcttctctgtaaagcagggattctccctaaaactcgaatctgcatctacaaaagcttgtgagattagcaggactttgacagaatagatgcatggcagggagtggcaggggggaccccaggagagaccctctggggtgaaagaaggacctgagtaaagcatgggggctggggctgcctagcaagcccacgaggatgcctgcattgaggccagttgctgggagtgaggcaggaggatgagatgtgggctcggggaggtctgcactcagcaaacaaggggccgaggagcccagacccccacccccaccctgccccaccccagccctgttcactcagagctgacactgaggtcgccacaggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacggtgcgcaccccttccggctcgggcagtaggcagggctgggactggctggggtgccaagggcccagcacacagcctggacgctgggacctgtctgtcctctgcagggcaaggtggaggctgagctgcatttactgacagcagaggaggcagagaagaacccagtgggcctggcccgcaatgaacctgaccccctagagaaacccaagtgagtgccctgccggcccagcccctccccacgctggctcttggaggcgctggaacaggaaggagacgctccccagacaccccatctcttcctgggccacagcctcattacaggggagcctcctccctgccctctgctgaccctgaatcccacaacgtccctttgaaccagaggatgggctaggaatactggagagcaggaccttccctgggaaaggccccatctagcggagagaaactatgctcttcccttcctagcttttgcagaagagccagctccagtggtggcctctggggccttggccagccttgatggccagaggggtgcctagaactgcacacacagcccaggacagcttccctcttggtctggatccctcgccacacccaatcccttctcctccctgtccctcctctgcgctctctacccttcatgctccagccggcccgacacgagcttcatctggttcctgaaccctctcaagtcggctcgctacttcttgtggcacacgtatcgctggctgctcctcaaactgttgctgctcctgctgctgctcctcctcctcgccctgttcctctactctgtgcctggctacctggtcaagaaaatcctcggggcctgagcccagtggcctcctgggtctgatatttcttacttcttcctctggaccaagggctaggcaggcacgtgcacacacacacacacacacatacacgcacacacacacatatacacgcacacatccacaaacacaaatatgcatacatgtgcacacaaacacacacaagcatgtatgcacacatgtgccacgcacaagtgcatacacatgcactcaagcacacacaggcacacacttaagcccacacaaacatgcacagcaactttcaagctttcatgacagaatagactctcagaactagaaatgactattttacacttttccacattaagccaaagaggtgaagtagcttgctcaaggttacccagcaaattagggtagagccgggactcaagccaaggtttccaaatttccaattctgtgttctttgcacaccacctctgctcccagccatgtttctcccagactctaacccaatttttttttttttttttttttttgagacagagtctcgctctgtcgcccaggctagagtgcagtggcacaatctcggctcactgccagctccgcctcccgggttcacgccattctcctgcctcagcctcccgagtagctgggactacaggcacccgccactacgcccggataattttttgtatttttagtagagacggggtttcaccgtgttagccaggatggtctcgatctcctgacctcgtgatccgcccatctcggcctcccaaagtgctgggattataggcgtgagccaccgcacccagccgactctaactcaatttcattggcaaaaagaagctgagctatggacagggaaaagggaagggtgtggccagggttagccaacaggtctggaaatggctctcacctgtgtgtgacctcccagtccagggctgctgttttctgcccttcaggataatagttccattcaactcaaacatttcatagccaccatggcctgaacacccaactgcaggtgctcagagctccccaggcactggctcactgtgccattgcgccaaacccaggaggtaggtactgcttgtaaccccattttatacatgaagaaaccgaggttgatagaggtgcctcacttgcctgtgaaaaccattcaaaaccaggtgtcctgcacccaagccccggctctgtgtccccaccaatactgagctcagctctggggctgcacgccatgtcctctgggaggcagtagtttgaaaatgcatatgcagtactttcacttgtatcttgacattttacaaaacctattgtttttataacacaaatgacagatagtgaggctggccaggtgcttctcggctgggaggctctacagaaggtggagtgggtcttcatcctgagagtgggcaggttggtgagggcagcttgcgccccacaggggctgctcagaccctcagcagggcccagtgggaacagccatttatgtccagaagggaagaggttgtgaagcaccggtcttaccaaggacatggggcagcacatagaacgagctaaccgcaggagcttcctaacgatgagaactgcctgcagggccaaggctgccccatgctgcaagtagctcccatctaggccttaggaggagattcgggccccaaaggtgctgcagggaggatagagttttgtaagcagcaagtcgggtacttagaaatgggttcaaaccctggctccagcattcactgcttttggggctggggccatggcagggcttttgggggtccagaaggacagaggatggggtgcactgggagacagctcctgcccactggctgaccagctcctctcttccacttcccagccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaaggccgccagctgctccccagccctgccgcatttcctttcagtggcttggactctttcccatctcccctggggaggctgaggagcccagcgttcactcttcatgccttgggccgagcctgcctcctgcttgcggggccgcctgtcctcactgccccaggctgcggcttgccgagtcccgcccctctgacccctgcctgtgggctgggcagccttggatggggtggggacctggaatgggtctctcttgccccacccggctgaggcgccacccttcttcaggcccaggctccagaggaagactcctgaaaccctccccaggtcttccaagtacaggattgaagctttagtgaaattaaccaaggaccatgggtcagtgcccagggctttaaaaagaatgaacgagcaaaaggtatccccaccgtgacccctgcagatagcaccggtctttgatccgcagcaggggccagaccctgcccacaagtcccggcacggctgcttctgccactgctgggctccacttggctcctctcacttcccagagtgtcgcctgtcctgcctgtgggtttccatggcttcccagagctccctctgccccagccagcgcctccaggcccagctgaggagctgtgagaagcagcagaggggactccccatcccgggcacaccctgtcctcccacccctgccccccttgcccttccagccctttcagctgcagctgggagctggcccgtcaagtgctgcccctgcctgtgtctgggtttctgttggctgtttttcttttcctgagtggtgatttttctctaaataaaagaagtcaagcactga

SEQ ID NO: 20 - protein, 1998 aa, Rattus norvegicus
MALIVHLKTVSELRGRADRIAKVTFRGQSFYSRVLENCEDVADFDETFRWPVASSIDRNEVLEIQIFNYSKVFSNKLIGTFRMVLQKVVEENRVEVSDTLIDDNNAIIKTSLSMEVRYQAADGTVGPWDDGDFLGDESLQEEEKDSQETDGLLPGSRPSTRTPGEKSFRRAGRSVFSAMKLGKTRSHKEEPQRQDEPAVLEMEDLDHLAIRLGDGLDPDSVSLASVTALTSNVSNKRSKPDIKMEPSAGRPMDYQVSITVIEARQLVGLNMDPVVCVEVGDDKKYTSMKESTNCPYYNEYFVFDFHVSPDVMFDKIIKISVIHSKNLLRSGTLVGSFKMDVGTVYSQPEHQFHHKWAILSDPDDISAGLKGYVKCDVAVVGKGDNIKTPHKANETDEDDIEGNLLLPEGVPPERQWARFYVKIYRAEGLPRMNTSLMANVKKAFIGENKDLVDPYVQVFFAGQKGKTSVQKSSYEPLWNEQVVFTDLFPPLCKRMKVQIRDSDKVNDVAIGTHFIDLRKISNDGDKGFLPTLGPAWVNMYGSTRNYTLLDEHQDLNEGLGEGVSFRARLMLGLAVEILDTSNPELTSSTEVQVEQATPVSESCTGRMEEFFLFGAFLEASMIDRKNGDKPVTFEVTIGNYGNEVDGTSRPQRPRPRKEPGDEEEVDLIQNSSDDEGDEAGDLASVSSTPPMRPQITDRNYFHLPYLERKPCIYIKSWWPDQRRRLYNANIMDHIADKLEEGLNDVQEMIKTEKSYPERRLRGVLEELSCGCHRFLSLSDKDQGHSSRTRLDRERLKSCMRELESMGQQAKSLRAQVKRHTVRDKLRLCQNFLQKLRFLADEPQHSIPDVFIWMMSNNKRIAYARVPSKDLLFSIVEEELGKDCAKVKTLFLKLPGKRGFGSAGWTVQAKLELYLWLGLSKQRKDFLCGLPCGFEEVKAAQGLGLHSFPPISLVYTKKQTFQLRAHMYQARSLFAADSTGLSDPFARVFFINQSQCTEVLNETLCPTWDQMLVFDNLELYGEAHELRDDPPIIVIEIYDQDSMGKADFMGRTFAKPLVKMADEAYCPPRFPPQLEYYQIYRGNATAGDLLAAFELLQIGPSGKADLPPINGPVDMDRGPIMPVPVGIRPVLSKYRVEVLFWGLRDLKRVNLAQVDRPRVDIECAGKGVQSSLIHNYKKNPNFNTLVKWFEVDLPENELLHPPLNIRVVDCRAFGRYTLVGSHAVSSLRRFIYRPPDRSAANWNTTVRLLRGYHMLCNGGPSSCPTGEVVVSMEPEVPVKKLETLVKLDATSDAVVKVDVAEDEKERKKKKKKGPSEEAEEEEPDESMLDWWSKYFASIDTMKEQLRQHETSGIDLEEKEEMDSTEGLKGPVKNKEKSRAAKEEKKKKNQNPGPGQGSEAPEKKKAKIDELKVYPKELESEFDNFEDWLHTFNLLRGKTGDDEDGSTEEERIVGRFKGSLCVYKVPLPEDVSREAGYDPTYGMFQGIPSNDPINVLVRIYVVRATDLHPADINGKADPYIAIKLGKTDIRDKENYISKQLNPVFGKSFDIEASFPMESMLTVAVYDWDLVGTDDLIGETKIDLENRFYSKHRATCGIAQTYSIHGYNIWRDPMKPSQILTRLCKEGKVDGPHFGPHGRVKVANRVFTGPSEIEDENGQRKPTDEHVALSALRHWEDIPRVGCRLVPEHVETRPLLNPDKPGIEQGRLELWVDMFPMDMPAPGTPLDISPRKPKKYELRVIVWNTDEVVLEDDDFFTGEKSSDIFVRGWLKGQQEDKQDTDVHYHSLTGEGNFNWRYLFPFDYLAAEEKIVMSKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTSFIWFLNPLKSARYFLWHTYRWLLLKLLLLLLLLLLLALFLYSLPGYLAKKILGA

SEQ ID NO: 21 - protein, 1992 aa, Danio rerio
MALVVHLKTVTELRGKGDRIAKVTFRGLSFFSRVLENCEDEARFEQAFRWPIGSQVDGDEMLEIQVFNYSKVFTNRLIGTFRMVLQKVVEEGHLEVSDTLIDDNNTAIQTTISIEIKYQTMDGSVKVWSDGEFLDIPDDLDGTFQFETDSLLSGRSQSSGTSPGRSIHGIPTFRKAGKGVFSAMKLGKTRTSKDDHKKGDDAAILDAEDLDRKAMRLGGILDPDTISLASVTAVTTNVSNKRSKPDIKMEPSSGRPVDYQISVTVIEARQLVGLNMDPVVCVEIGEEKKYTSMKESTNCPYYNEYFVFDFHVPPDVMFDKIIKISVIHSKNLLRSGTLVGTFKLDVGTVYTQPEHQFHHKWAMLSDPDDITTGCKGYVKCDIAVVGKGDNIKTPHKASEADEDDIEGNLLLPEGVPSERQWARFYVKIYRAEGLPKMNTSIMANVKKAFIGENRDLVDPYVLVQFAGQKGKTSVQKSSYEPIWNEQVIFTEMFPPLCRRLKVQIRDSDKVNDVAIGTHFIDLRKVSNDGDKGFLPTMGPAWVNMYGSTRNYTLMDEHQDLNEGLGEGVSFRARLLISIAVEILDTTSAEIMSSTEVHMEPVSNISESATGKMEEFFLFGSFLEATMIDRKIGDKPISFEVTIGNYGNQIDGVSKPALAKKKKEGGGESEEEESELIHNSSEEEAEDDGDLTSVPSTPPMKPVITDRNYFHLPYFEKKPCIYIKSWWQDQRRRLYNSNIMDKIADKLEEGLNDVQEIIKTEKAYPERRLRGVLEELSTSCSRFVTLANKDQNLSGRTKLDRERLKSCMREMESMGQQAKTIRTQVKRNTVRDKLKLVLNFLQRLRFLADEPQHSIPDVFIWMISNNKRIAYARIPSKDILYSIVDEEMGKDCGKVKAVFLRLPGKKGFGPAGWTVQAKLEMYLWLGLNKQRKDFLIGLPSGFEENKAVKGIGIQAVPPISLVYNMKQVFQLRAHMYQARSLFAADTSGLSDPFARVFFSTHSQVTEVLSETLCPTWDQLLVFDNVELYGEAGELRDDPPIIVIELYDQDTVGKAEFIGRTFAKPLTKMVDEHYGPPRFPPQLEYYQIYRGNCAAGDLLAAFELLQIGPAGRAALPPIDGPTDSDRGPILPVPLGIRPVLSRYRIEVLFWGLRDLKRVNLAQVDRPRVDIECAGKGVQSALIQNYKKNPNFSTLVKWFEVDLPENELLHPPLNIRVVDCRAFGRYILVGSHAVTTLRKFIYSPPDKTANNWAHTGDIVVNMSPEPNIKKMDTVVKIEATTDAVVKVDLNEDEKEKEKKKKKKKKGEEVEEEEPDESMLDWWSKYFASIETMMENLRAQEAAQAEAEEREDLEIAAESAEIKADDFPMKGTKPKEKSKDKKSTKDKKKNNDGTEKRPPKPKVDELMVYNKELESEFGSFEDWLHTFNLYRGKAGDDDDHNVVDEDRIVGRFKGSLCMYKLPLSEEITREAGFDPNMGMFQSIPHNDPINVLVRIYIIRATDLHPADINGKADPYIVIKLGKSDIRDKENYISKQLNPVFGKSFDIEATFPMESMLTVAVYDWDLVGTDDLIGETKIDLENRYYSKHRATCGIASNYSVHGYNVWRDPQKPAQILAKLCKEGKLDGPHYGPGGRVKVANRIFLGPTEIEDESGLKKQTEEHLALTVLRHWEEIPRVGCKLIPEHVETRPLLNPDKPGIEQGRIEMWVDMFPMDVPAPGPAIDISPRKPKRYELRVIIWNTDEVILEDDDYFTGEKSSDIFVRGWLKGQQEDKQDTDVHYHSLTGEGNFNWRFVFPFDYLMAEEKIVISKKESMFSWDETEYKIPARLTLQVWDADHFSADDFLGAIELDLNKFPRGAKTAKQCSLDMVLKEHELPTISIFKQKRVKGWWPFVAQNENDEFELTGKVEAELHLLTAEEAEKSPVGLGRNDPEPLEKPNRPDTSLMWFMNPLRSIRYFIWHNYRWLILKALALLLLLLLVGLFLYSIPGYLVKKLLGA

SEQ ID NO: 22 - protein, 1998 aa, Bos taurus
MALLVHLKTVSELRGKGDRIAKVTFRGQSFYSRVLESCEDVADFDETFRWPVASSIDSNEMLEIQIFNYSKVFSNKLIGTFRMVLQKVVEENHVEVTDTLMDDNNAIIKTSLCVEVRYQATDGTVGSWDDGDFLGEESLHEEEKDSQETDGLLPGSRPSSRPSGEKSFRRAGRSVFSAMKLGKNRPHKEEPQRQDEPAVLEMEDLDRLAIRLGDGLDPDSVSLASVTALTTNVSNKRSKPDIKMEPSAGRPMDYQVSVTVIEARQLVGLNMDPVVCVEVGDEKKYTSMKESTNCPYYNEYFVFDFHVSPDVMFDKIIKISVIHSKNLLRSGTLVGSFKMDVGTVYSQPEHQFHHKWAVLSDPDDISAGLKGYVKCDVAVVGKGDNIKTPHKANETDEDDIEGNLLLPEGVPPERQWARFYVKIYRAEGLPRMNTSLMANVKKAFTGENKDLVDPYVQVFFAGQKGKTSVQKSSYEPLWNEQVVFTDLFPPLCKRMKVQIRDSDKVNDVAIGTHFIDLRKISNDGDKGFLPTLGPAWVNMYGSTRNYTLLDEHQDLNEGLGEGVSFRARLMLGLAVEILDTSNPEITSSTEVQVEQATPISESCTGKIEEFFLFGAFLEASMIDRKNGDKPITFEVTVGNYGNEVDGLSRPHRPRPRKEPGDEEEVDLIQNLSDEETDEGGGLASVSSTPPMRPQITDRNYFHLPYLEHKPCIYIKSWWPDQRRRLYNANIMDHIADKLEEGLNDVQEMIKTEKSYPERRLRGVLEELSSGCYRFLSLADKDQGHSSRTRLDRERLKSCMRELESMGQQAKTLRAQVKRHTVRDKLRLCQNFLQKLRFLADEPQHSIPDVFIWMMSNNKRIAYTRVPSKDLLFSIVEEELGKDCAKVKTLFLKLPGKRGFGSAGWTVQAKLELYLWLGLSKQRKDFLCGLPCGFEEVKAAQGLGLLSFPPISLVYTKKQAFQLRAHMYQARSLFAADSTGLSDPFARVFFINQSQCTEVLNETLCPTWDQMLVFDNLELYGEAHELRDDPPIIVIEIYDQDTMGKADFMGRTFAKPLVKMADEAYCPPRFPPQLEYYQIYRGNATAGDLLAAFELLQIGPAGKADLPPINGPVDMDRGPIMPVPVGIRPVLSKYRVEVLFWGLRDLKRVNLAQVDRPRVDIECAGKGVQSSLIHNYKKNPNFSTLVKWFEVDLPENELLHPPLNIRVVDCRAFGRYTLVGSHAVSSLRRFIYRPPDRSAPNWNTSGRLLQGRRGLYSGGPSSRLTGEVVVSMEPEVPIKKLETMVKLDATSDAVIKVDVAEEEKERKKKKKKGSSDEPEEEEPDESMLDWWSKYFASIDTMKEQIRQQEISGIDLEEKEEMDNTEGLKGPMKGKEKARAAKEEKKKRTQSLGPGQGSEAPEKRKPKIDELKVYPKELESEFDNFEDWLHTFNLLRGKTGDDEDGGTEEERIVGRFKGSLCVYKVPLPEDVSREAGYDPTYGMFQGIPSNDPINVLVRVYVVRATDLHPADINGKADPYIAIRLGKTDIRDKENYISKQLNPVFGKSFDIEACFPMESMLTVAVYDWDLVGTDDLIGETKIDLENRFYSKHRATCGIAQTYSVHGYNIWRDPMKPSQILTRLCKEGKVDGPHFGPPGRVKVSNRIFTGPSEIEDENGQRKPTEEHVALLALRHWEDIPRVGCRLVPEHVETRPLLNPDKPGIEQGRLELWVDMFPMDMPSPGTPLDISPRKPKKYELRVIVWNTDEVVLEDDDFFTGEKSSDIFVRGWLKGQQEDKQDTDVHYHSLTGEGNFNWRYLFPFDYLAAEEKIVISKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTAFVWFLNPLKSIKYLICTRYKWLIIKIVLALLGLLMLALFLYSLPGYMVKKLLGA

SEQ ID NO: 23 - protein, 1996 aa, Papio anubis
MALLIHLKTVSELRGRGDRIAKVTFRGQSFYSRVLENCEDVADFDETFRWPVASSIDRNEMLEIQVFNYSKVFSNKLIGTFRMVLQKVVEESHVEVTDTLIDDNNAIIKTSLCVEVRYQATDGTVGSWDDGDFLGDECLQEEEKDSQETDGLLPGSRPSSRPPGEKSFRRAGRSVFSAMKLGKNRSHKEETQRPDEPAVLEMEDLDHLAIRLGDGLDPDSVSLASVTALTTNVSNKRSKPDIKMEPSAGRPMDYQVSITVIEARQLVGLNMDPVVCVEVGDDKKYTSMKESTNCPYYNEYFVFDFHVSPDVMFDKIIKISVIHSKNLLRSGTLVGSFKMDVGTVYSQPEHQFHHKWAILSDPDDISSGLKGYVKCDVAVVGKGDNIKTPHKANETDEDDIEGNLLLPEGVPPERQWARFYVKIYRAEGLPRMNTSLMANVKKAFIGENKDLVDPYVQVFFAGQKGKTSVQKSSYEPLWNEQVVFTDLFPPLCKRMKVQIRDSDKVNDMAIGTHFIDLRKISNDGDKGFLPTLGPAWVNMYGSTRNYTLLDEHQDLNEGLGEGVSFRARLLLGLAVEILDTSNPELTSSTEVQVEQATPISESCAGKMEEFFLFGAFLEASMIDRRNGDKPITFEVTIGNYGNEIDGLSRPQRPQPRKEPGDEEEVDLIQNSSDDEASDGGDLASVSSTPPMRPLVTDRNYFHLPYLERKPCIYIKSWWPDQRRRLYNASIMDHIADKLEEGLNDVQEMIKTEKFYPERRLRGVLEELSCGCCRFLSLADKDQGHSSRTRLDRERLKFCMRELESMGQQARTLRAQVKRHTVRDKLRLCQNFLQKLRFLADEPQHSIPDIFIWMMSNNKRIAYARVPSKDLLFSIVEEETGKDCAKVKTLFLKLPGKRGFGSAGWTVQAKVELYLWLGLSKQRKDFLCGLPCGFQEVKAAQGLGLHAFPPVSLVYTKKQTFQLRAHMYQARSLFAADSSGLSDPFARVFFINQSQCTEVLNETLCPTWDQMLVFDNLELYGEAHELRDDPPIIVIEIYDQDSMGKADFMGRTFAKPLVKMADEAYCPPRFPPQLEYYQIYRGNATAGDLLAAFELLQIGPAGKADLPPINGPVDVDRGPIMPVPVGIRPVLSKYRVEVLFWGLRDLKRVNLAQVDRPRVDIECAGKGVQSSLIHNYKKNPNFNTLVKWFEVDLPENELLHPPLNIRVVDCRAFGRYTLVGSHAVSSLRRFIYRPPDHSAPSWNTTVRLLRRCRVLCNGGPSSHSTGEVVVNMEPEVPIKKLETMVKLDATSEAVVKVDVAEEEKEKKKKKGTAEEPEEEEPDESMLDWWSKYFASIDTMKEQLRQQEPSGIDLEEKEEVDNTEGLKGSMKGKEKARAAKEERRKKTQSSGSGQGSEAPEKKKPKIDELKVYPKELECEFDNFEDWLHTFNLLRGKTGDDEDGSTEEERIVGRFKGSLCVYKVPLPEDVSREAGYDPTYGMFQGIPSNDPINVLVRVYVVRATDLHPADINGKADPYIAIRLGKTDIRDKENYISKQLNPVFGKSFDIEASFPMESMLTVAVYDWDLVGTDDLIGETKIDLENRFYSKHRATCGIAQTYSTHGYNIWRDPMKPSQILTRLCKDSKVDGPHFGPPGRVKVANRVFTGPSEIEDENGQRKPTDEHVALSALRHWEDIPRAGCRLVPEHVETRPLLNPDKPGIEQGRLELWVDMFPMDMPAPGTPLDISPRKPKKYELRVIIWNTDEVVLEDDDFFTGEKSSDIFVRGWLKGQQEDKQDTDVHYHSLTGEGNFNWRYLFPFDYLAAEERIVISKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTAFVWFLNPLKSIKYLICTRYKWLIIKIVLALLGLLMLGLFLYSLPGYMVKKLLGA

SEQ ID NO: 24 - DNA, 29 bp, synthetic construct
  source 1..29: mol_type = other DNA; note = Synthetic primer
cccacaaggccaacgagacggatgaggac

SEQ ID NO: 25 - DNA, 30 bp, synthetic construct
  source 1..30: mol_type = other DNA; note = Synthetic primer
aagaggcttcgggcctgatacatgtgtgct

SEQ ID NO: 26 - DNA, 30 bp, synthetic construct
  source 1..30: mol_type = other DNA; note = Synthetic primer
acggcaatgaagtcgatggtatgtcccggc

SEQ ID NO: 27 - DNA, 30 bp, synthetic construct
  source 1..30: mol_type = other DNA; note = synthetic primer
ctgacctgccacccatcaatggcccagtgg

SEQ ID NO: 28 - DNA, 30 bp, synthetic construct
  source 1..30: mol_type = other DNA; note = Synthetic primer
ctatgcgctcctcctctgtggagccatcct

SEQ ID NO: 29 - DNA, 23 bp, synthetic construct
  source 1..23: mol_type = other DNA; note = Synthetic primer
ttcacctgggcccgcagcatcct

SEQ ID NO: 30 - DNA, 24 bp, synthetic construct
  source 1..24: mol_type = other DNA; note = synthetic primer
aggcgtgtgagccacactccacca

SEQ ID NO: 31 - DNA, 24 bp, synthetic construct
  source 1..24: mol_type = other DNA; note = Synthetic primer
cataacctcagcttgtcccgaaca

SEQ ID NO: 32 - DNA, 23 bp, synthetic construct
  source 1..23: mol_type = other DNA; note = Synthetic primer
ggccccagatcacggacaggaac

SEQ ID NO: 33 - DNA, 23 bp, synthetic construct
  source 1..23: mol_type = other DNA; note = Synthetic primer
ggccagtacacctgattcacact

SEQ ID NO: 34 - DNA, 23 bp, synthetic construct
  source 1..23: mol_type = other DNA; note = Synthetic primer
ggaggaggcagcggcagagaaga

SEQ ID NO: 35 - DNA, 23 bp, synthetic construct
  source 1..23: mol_type = other DNA; note = Synthetic primer
ttcacctgggcccgcagcatcct

SEQ ID NO: 36 - DNA, 28 bp, synthetic construct
  source 1..28: mol_type = other DNA; note = Synthetic primer
ataagcttacgctcagtggaacgaaaac

SEQ ID NO: 37 - DNA, 34 bp, synthetic construct
  source 1..34: mol_type = other DNA; note = Synthetic primer
ataagcttgacgtgtcagtgtcagtcctgctcct

SEQ ID NO: 38 - skipped

SEQ ID NO: 39 - DNA, 7625 bp, synthetic construct
  source 1..7625: mol_type = other DNA
tgggattttgccgatttcggcctattggttaaaaaatgagctgatttaacaaaaatttaacgcgaattttaacaaaatgataggcacctattggtcttactgacatccactttgcctttctctccacagccccagcacagcattccggatgtgttcatttggatgatgagcaacaacaaacgtatcgcctatgcccgcgtgccttccaaagacctgctcttctccatcgtggaggaggaactgggcaaggactgcgccaaagtcaagaccctcttcctgaagctgccagggaagaggggcttcggctcggcaggctggacagtacaggccaagctggagctctacctgtggctgggcctcagcaagcagcgaaaggacttcctgtgtggtctgccctgtggcttcgaggaggtcaaggcagcccaaggcctgggcctgcattcctttccgcccatcagcctagtctacaccaagaagcaagccttccagctccgagcacacatgtatcaggcccgaagcctctttgctgctgacagcagtgggctctctgatccctttgcccgtgtcttcttcatcaaccagagccaatgcactgaggttctaaacgagacactgtgtcccacctgggaccagatgctggtatttgacaacctggagctgtacggtgaagctcacgagttacgagatgatccccccatcattgtcattgaaatctacgaccaggacagcatgggcaaagccgacttcatgggccggaccttcgccaagcccctggtgaagatggcagatgaagcatactgcccacctcgcttcccgccgcagcttgagtactaccagatctaccgaggcagtgccactgccggagacctactggctgccttcgagctgctgcagattgggccatcagggaaggctgacctgccacccatcaatggcccagtggacatggacagagggcccatcatgcctgtgcccgtgggaatccggccagtgctcagcaagtaccgagtggaggtgctgttctggggcctgagggacctaaagagggtgaacctggcccaggtggaccgaccacgggtggacatcgagtgtgcaggaaagggggtacaatcctccctgattcacaattataagaagaaccccaacttcaacacgctggtcaagtggtttgaagtggacctcccggagaatgagctcctgcacccacccttgaacatccgagtggtagattgccgggcctttggacgatacaccctggtgggttcccacgcagtcagctcactgaggcgcttcatctaccgacctccagaccgctcagcccccaactggaacaccacaggggaggttgtagtaagcatggagcctgaggagccagttaagaagctggagaccatggtgaaactggatgcgacttctgatgctgtggtcaaggtggatgtggctgaagatgagaaggaaaggaagaagaagaaaaagaaaggcccgtcagaggagccagaggaggaagagcccgatgagagcatgctggattggtggtccaagtacttcgcctccatcgacacaatgaaggagcaacttcgacaacatgagacctctggaactgacttggaagagaaggaagagatggaaagcgctgagggcctgaagggaccaatgaagagcaaggagaagtccagagctgcaaaggaggagaaaaagaagaaaaaccagagccctggccctggccagggatcggaggctcctgagaagaagaaagccaagatcgatgagcttaaggtgtaccccaaggagctggaatcggagtttgacagctttgaggactggctgcacaccttcaacctgttgaggggcaagacgggagatgatgaggatggctccacagaggaggagcgcatagtaggccgattcaagggctccctctgtgtgtacaaagtgccactcccagaagatgtatctcgagaagctggctatgatcccacctatggaatgttccagggcatcccaagcaatgaccccatcaatgtgctggtccgaatctatgtggtccgggccacagacctgcacccggccgacatcaatggcaaagctgacccctatattgccatcaagttaggcaagaccgacatccgagacaaggagaactacatctccaagcagctcaaccctgtgtttgggaagtcctttgacattgaggcctccttccccatggagtccatgttgacagtggccgtgtacgactgggatctggtgggcactgatgacctcatcggagaaaccaagattgacctggaaaaccgcttctacagcaagcatcgcgccacctgcggcatcgcacagacctattccatacatggctacaatatctggagggaccccatgaagcccagccagatcctgacacgcctctgtaaagagggcaaagtggacggcccccactttggtccccatgggagagtgagggttgccaaccgtgtcttcacggggccttcagaaatagaggatgagaatggtcagaggaagcccacagatgagcacgtggcactgtctgctctgagacactgggaggacatcccccgggtgggctgccgccttgtgccggaacacgtggagaccaggccgctgctcaaccctgacaagccaggcattgagcagggccgcctggagctgtgggtggacatgttccccatggacatgccagcccctgggacacctctggatatatcccccaggaaacccaagaagtacgagctgcgggtcatcgtgtggaacacagacgaggtggtcctggaagacgatgatttcttcacgggagagaagtccagtgacatttttgtgagggggtggctgaagggccagcaggaggacaaacaggacacagatgtccactatcactccctcacgggggagggcaacttcaactggagatacctcttccccttcgactacctagcggccgaagagaagatcgttatgtccaaaaaggagtctatgttctcctgggatgagacggagtacaagatccctgcgcggctcaccctgcagatctgggacgctgaccacttctcggctgacgacttcctgggggctatcgagctggacctgaaccggttcccgaggggcgctaagacagccaagcagtgcaccatggagatggccaccggggaggtggacgtacccctggtttccatctttaaacagaaacgtgtcaaaggctggtggcccctcctggcccgcaatgagaatgatgagtttgagctcacaggcaaagtggaggcggagctacacctactcacggcagaggaggcagagaagaaccctgtgggcctggctcgcaatgaacctgatcccctagaaaaacccaaccggcctgacacggcattcgtctggttcctgaacccactcaaatctatcaagtacctcatctgcacccggtacaagtggctgatcatcaagatcgtgctggcgctgctggggctgctcatgctggccctcttcctttacagcctcccaggctacatggtcaagaagctcctaggggcctgaggtaccgcgggcccgggatccactagttctagagcggccgcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgatcgataccgtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaacccccccccccccccccctgcagccagctggcgtaatagcgaagaggcccgcaccgatcgcccttcccaacagttgcgtagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgggctgcaggggggggggggggggggttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctaggatcacgcg

SEQ ID NO: 40 - DNA, 7548 bp, synthetic construct
  source 1..7548: mol_type = other DNA
tgataggcacctattggtcttactgacatccactttgcctttctctccacagccccagcacagcattccggatgtgttcatttggatgatgagcaacaacaaacgtatcgcctatgcccgcgtgccttccaaagacctgctcttctccatcgtggaggaggaactgggcaaggactgcgccaaagtcaagaccctcttcctgaagctgccagggaagaggggcttcggctcggcaggctggacagtacaggccaagctggagctctacctgtggctgggcctcagcaagcagcgaaaggacttcctgtgtggtctgccctgtggcttcgaggaggtcaaggcagcccaaggcctgggcctgcattcctttccgcccatcagcctagtctacaccaagaagcaagccttccagctccgagcacacatgtatcaggcccgaagcctctttgctgctgacagcagtgggctctctgatccctttgcccgtgtcttcttcatcaaccagagccaatgcactgaggttctaaacgagacactgtgtcccacctgggaccagatgctggtatttgacaacctggagctgtacggtgaagctcacgagttacgagatgatccccccatcattgtcattgaaatctacgaccaggacagcatgggcaaagccgacttcatgggccggaccttcgccaagcccctggtgaagatggcagatgaagcatactgcccacctcgcttcccgccgcagcttgagtactaccagatctaccgaggcagtgccactgccggagacctactggctgccttcgagctgctgcagattgggccatcagggaaggctgacctgccacccatcaatggcccagtggacatggacagagggcccatcatgcctgtgcccgtgggaatccggccagtgctcagcaagtaccgagtggaggtgctgttctggggcctgagggacctaaagagggtgaacctggcccaggtggaccgaccacgggtggacatcgagtgtgcaggaaagggggtacaatcctccctgattcacaattataagaagaaccccaacttcaacacgctggtcaagtggtttgaagtggacctcccggagaatgagctcctgcacccacccttgaacatccgagtggtagattgccgggcctttggacgatacaccctggtgggttcccacgcagtcagctcactgaggcgcttcatctaccgacctccagaccgctcagcccccaactggaacaccacaggggaggttgtagtaagcatggagcctgaggagccagttaagaagctggagaccatggtgaaactggatgcgacttctgatgctgtggtcaaggtggatgtggctgaagatgagaaggaaaggaagaagaagaaaaagaaaggcccgtcagaggagccagaggaggaagagcccgatgagagcatgctggattggtggtccaagtacttcgcctccatcgacacaatgaaggagcaacttcgacaacatgagacctctggaactgacttggaagagaaggaagagatggaaagcgctgagggcctgaagggaccaatgaagagcaaggagaagtccagagctgcaaaggaggagaaaaagaagaaaaaccagagccctggccctggccagggatcggaggctcctgagaagaagaaagccaagatcgatgagcttaaggtgtaccccaaggagctggaatcggagtttgacagctttgaggactggctgcacaccttcaacctgttgaggggcaagacgggagatgatgaggatggctccacagaggaggagcgcatagtaggccgattcaagggctccctctgtgtgtacaaagtgccactcccagaagatgtatctcgagaagctggctatgatcccacctatggaatgttccagggcatcccaagcaatgaccccatcaatgtgctggtccgaatctatgtggtccgggccacagacctgcacccggccgacatcaatggcaaagctgacccctatattgccatcaagttaggcaagaccgacatccgagacaaggagaactacatctccaagcagctcaaccctgtgtttgggaagtcctttgacattgaggcctccttccccatggagtccatgttgacagtggccgtgtacgactgggatctggtgggcactgatgacctcatcggagaaaccaagattgacctggaaaaccgcttctacagcaagcatcgcgccacctgcggcatcgcacagacctattccatacatggctacaatatctggagggaccccatgaagcccagccagatcctgacacgcctctgtaaagagggcaaagtggacggcccccactttggtccccatgggagagtgagggttgccaaccgtgtcttcacggggccttcagaaatagaggatgagaatggtcagaggaagcccacagatgagcacgtggcactgtctgctctgagacactgggaggacatcccccgggtgggctgccgccttgtgccggaacacgtggagaccaggccgctgctcaaccctgacaagccaggcattgagcagggccgcctggagctgtgggtggacatgttccccatggacatgccagcccctgggacacctctggatatatcccccaggaaacccaagaagtacgagctgcgggtcatcgtgtggaacacagacgaggtggtcctggaagacgatgatttcttcacgggagagaagtccagtgacatttttgtgagggggtggctgaagggccagcaggaggacaaacaggacacagatgtccactatcactccctcacgggggagggcaacttcaactggagatacctcttccccttcgactacctagcggccgaagagaagatcgttatgtccaaaaaggagtctatgttctcctgggatgagacggagtacaagatccctgcgcggctcaccctgcagatctgggacgctgaccacttctcggctgacgacttcctgggggctatcgagctggacctgaaccggttcccgaggggcgctaagacagccaagcagtgcaccatggagatggccaccggggaggtggacgtacccctggtttccatctttaaacagaaacgtgtcaaaggctggtggcccctcctggcccgcaatgagaatgatgagtttgagctcacaggcaaagtggaggcggagctacacctactcacggcagaggaggcagagaagaaccctgtgggcctggctcgcaatgaacctgatcccctagaaaaacccaaccggcctgacacggcattcgtctggttcctgaacccactcaaatctatcaagtacctcatctgcacccggtacaagtggctgatcatcaagatcgtgctggcgctgctggggctgctcatgctggccctcttcctttacagcctcccaggctacatggtcaagaagctcctaggggcctgaggtaccgcgggcccgggatccactagttctagagcggccgcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgatcgataccgtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaacccccccccccccccccctgcagccagctggcgtaatagcgaagaggcccgcaccgatcgcccttcccaacagttgcgtagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgggctgcaggggggggggggggggggttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctaggatcacgcg

SEQ ID NO: 41 - DNA, 7346 bp, synthetic construct
  source 1..7346: mol_type = other DNA
gacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcggccgggcccagcaccccaaggcggccaacgccaaaactctcccccctcctcttcctcaatctcgctctcgctctttttttttttcgcaaaaggaggggagagggggtaaaaaaatgctgcactgtgcggcgaagccggtgagtgagcggcgcggggccaatcagcgtgcgccgttccgaaagttgccttttatggctcgagcggccggccgcggcggcgccctataaaacccagcggcgcgacgcgccaccaccgccgagaccgcgtccgccccgcgagcacagagcctcgcctttgccgatccgccgcccgtccacacccgccgccaggtaagcccggccagccgaccggggcaggcggctcacggcccggccgcaggcggccgcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagaagcttggaagcggagctactaacttcagcctgctgaagcaggctggagacgtggaggagaaccctggacctgaattcgccaccatggccctgattgttcacctcaagactgtctcagagctccgaggcaaaggtgaccggattgccaaagtcactttccgagggcagtctttctactcccgggtcctggagaactgcgagggtgtggctgactttgatgagacgttccggtggccagtggccagcagcatcgaccggaatgaagtgttggagattcagattttcaactacagcaaagtcttcagcaacaagctgatagggaccttctgcatggtgctgcagaaagtggtggaggagaatcgggtagaggtgaccgacacgctgatggatgacagcaatgctatcatcaagaccagcctgagcatggaggtccggtatcaggccacagatggcactgtgggcccctgggatgatggagacttcctgggagatgaatccctccaggaggagaaggacagccaggagacagatgggctgctacctggttcccgacccagcacccggatatctggcgagaagagctttcgcagagcgggaaggagtgtgttctcggccatgaaactcggcaaaactcggtcccacaaagaggagccccaaagacaagatgagccagcagtgctggagatggaggacctggaccacctagccattcagctgggggatgggctggaccctgactccgtgtctctagcctcggtcaccgctctcaccagcaatgtctccaacaaacggtctaagccagatattaagatggagcccagtgctggaaggcccatggattaccaggtcagcatcacagtgattgaggctcggcagctggtgggcttgaacatggaccctgtggtgtgtgtggaggtgggtgatgacaagaaatacacgtcaatgaaggagtccacaaactgcccttactacaacgagtactttgtcttcgacttccatgtctctcctgatgtcatgtttgacaagatcatcaagatctcggttatccattctaagaacctgcttcggagcggcaccctggtgggttccttcaaaatggatgtggggactgtgtattcccagcctgaacaccagttccatcacaaatgggccatcctgtcagaccccgatgacatctctgctgggttgaagggttatgtaaagtgtgatgtcgctgtggtgggcaagggagacaacatcaagacaccccacaaggccaacgagacggatgaggacgacattgaagggaacttgctgctccccgagggcgtgccccccgaacggcagtgggcacggttctatgtgaaaatttaccgagcagagggactgccccggatgaacacaagcctcatggccaacgtgaagaaggcgttcatcggtgagaacaaggacctcgtcgacccctatgtgcaagtcttctttgctggacaaaagggcaaaacatcagtgcagaagagcagctatgagccgctatggaatgagcaggtcgtcttcacagacttgttccccccactctgcaaacgcatgaaggtgcagatccgggactctgacaaggtcaatgatgtggccatcggcacccacttcatcgacctgcgcaagatttccaacgatggagacaaaggcttcctgcctaccctcggtccagcctgggtgaacatgtacggctccacgcgcaactacacactgctggacgagcaccaggacttgaatgaaggcctgggggagggtgtgtccttccgggcccgcctcatgttgggactagctgtggagatcctggacacctccaacccagagctcaccagctccacggaggtgcaggtggagcaggccacgcctgtctcggagagctgcacagggagaatggaagaattttttctatttggagccttcttggaagcctcaatgattgaccggaaaaatggggacaagccaattacctttgaggtgaccataggaaactacggcaatgaagtcgatggtatgtcccggcccctgaggcctcggccccggaaagagcctggggatgaagaagaggtagacctgattcagaactccagtgacgatgaaggtgacgaagccggggacctggcctcggtgtcctccaccccacctatgcggccccagatcacggacaggaactatttccacctgccctacctggagcgcaagccctgcatctatatcaagagctggtggcctgaccagaggcggcgcctctacaatgccaacatcatggatcacattgctgacaagctggaagaaggcctgaatgatgtacaggagatgatcaaaacggagaagtcctacccggagcgccgcctgcggggtgtgctagaggaactcagctgtggctgccaccgcttcctctccctctcggacaaggaccagggccgctcgtcccgcaccaggctggatcgagagcgtcttaagtcctgtatgagggagttggagagcatgggacagcaggccaagagcctgagggctcaggtgaagcggcacactgttcgggacaagctgaggtcatgccagaactttctgcagaagctacgcttcctggcggatgaggtaagtatcaaggttacaagacaggtttaaggagaccaatagaaactgggcttgtcgagacagagaagactcttgcgtttctggcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaacccccccccccccccccctgcagccagctggcgtaatagcgaagaggcccgcaccgatcgcccttcccaacagttgcgtagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgggctgcaggggggggggggggggggttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctaggatcacgcgttctagatcccatatatggagttccgcgttacataacttacggtaaatggcccgcctggctgaccgcccaac

SEQ ID NO: 42 - DNA, 7423 bp, synthetic construct
  source 1..7423: mol_type = other DNA
gacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcggccgggcccagcaccccaaggcggccaacgccaaaactctcccccctcctcttcctcaatctcgctctcgctctttttttttttcgcaaaaggaggggagagggggtaaaaaaatgctgcactgtgcggcgaagccggtgagtgagcggcgcggggccaatcagcgtgcgccgttccgaaagttgccttttatggctcgagcggccggccgcggcggcgccctataaaacccagcggcgcgacgcgccaccaccgccgagaccgcgtccgccccgcgagcacagagcctcgcctttgccgatccgccgcccgtccacacccgccgccaggtaagcccggccagccgaccggggcaggcggctcacggcccggccgcaggcggccgcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagaagcttggaagcggagctactaacttcagcctgctgaagcaggctggagacgtggaggagaaccctggacctgaattcgccaccatggccctgattgttcacctcaagactgtctcagagctccgaggcaaaggtgaccggattgccaaagtcactttccgagggcagtctttctactcccgggtcctggagaactgcgagggtgtggctgactttgatgagacgttccggtggccagtggccagcagcatcgaccggaatgaagtgttggagattcagattttcaactacagcaaagtcttcagcaacaagctgatagggaccttctgcatggtgctgcagaaagtggtggaggagaatcgggtagaggtgaccgacacgctgatggatgacagcaatgctatcatcaagaccagcctgagcatggaggtccggtatcaggccacagatggcactgtgggcccctgggatgatggagacttcctgggagatgaatccctccaggaggagaaggacagccaggagacagatgggctgctacctggttcccgacccagcacccggatatctggcgagaagagctttcgcagagcgggaaggagtgtgttctcggccatgaaactcggcaaaactcggtcccacaaagaggagccccaaagacaagatgagccagcagtgctggagatggaggacctggaccacctagccattcagctgggggatgggctggaccctgactccgtgtctctagcctcggtcaccgctctcaccagcaatgtctccaacaaacggtctaagccagatattaagatggagcccagtgctggaaggcccatggattaccaggtcagcatcacagtgattgaggctcggcagctggtgggcttgaacatggaccctgtggtgtgtgtggaggtgggtgatgacaagaaatacacgtcaatgaaggagtccacaaactgcccttactacaacgagtactttgtcttcgacttccatgtctctcctgatgtcatgtttgacaagatcatcaagatctcggttatccattctaagaacctgcttcggagcggcaccctggtgggttccttcaaaatggatgtggggactgtgtattcccagcctgaacaccagttccatcacaaatgggccatcctgtcagaccccgatgacatctctgctgggttgaagggttatgtaaagtgtgatgtcgctgtggtgggcaagggagacaacatcaagacaccccacaaggccaacgagacggatgaggacgacattgaagggaacttgctgctccccgagggcgtgccccccgaacggcagtgggcacggttctatgtgaaaatttaccgagcagagggactgccccggatgaacacaagcctcatggccaacgtgaagaaggcgttcatcggtgagaacaaggacctcgtcgacccctatgtgcaagtcttctttgctggacaaaagggcaaaacatcagtgcagaagagcagctatgagccgctatggaatgagcaggtcgtcttcacagacttgttccccccactctgcaaacgcatgaaggtgcagatccgggactctgacaaggtcaatgatgtggccatcggcacccacttcatcgacctgcgcaagatttccaacgatggagacaaaggcttcctgcctaccctcggtccagcctgggtgaacatgtacggctccacgcgcaactacacactgctggacgagcaccaggacttgaatgaaggcctgggggagggtgtgtccttccgggcccgcctcatgttgggactagctgtggagatcctggacacctccaacccagagctcaccagctccacggaggtgcaggtggagcaggccacgcctgtctcggagagctgcacagggagaatggaagaattttttctatttggagccttcttggaagcctcaatgattgaccggaaaaatggggacaagccaattacctttgaggtgaccataggaaactacggcaatgaagtcgatggtatgtcccggcccctgaggcctcggccccggaaagagcctggggatgaagaagaggtagacctgattcagaactccagtgacgatgaaggtgacgaagccggggacctggcctcggtgtcctccaccccacctatgcggccccagatcacggacaggaactatttccacctgccctacctggagcgcaagccctgcatctatatcaagagctggtggcctgaccagaggcggcgcctctacaatgccaacatcatggatcacattgctgacaagctggaagaaggcctgaatgatgtacaggagatgatcaaaacggagaagtcctacccggagcgccgcctgcggggtgtgctagaggaactcagctgtggctgccaccgcttcctctccctctcggacaaggaccagggccgctcgtcccgcaccaggctggatcgagagcgtcttaagtcctgtatgagggagttggagagcatgggacagcaggccaagagcctgagggctcaggtgaagcggcacactgttcgggacaagctgaggtcatgccagaactttctgcagaagctacgcttcctggcggatgaggtaagtatcaaggttacaagacaggtttaaggagaccaatagaaactgggcttgtcgagacagagaagactcttgcgtttctgggattttgccgatttcggcctattggttaaaaaatgagctgatttaacaaaaatttaacgcgaattttaacaaaatggcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaacccccccccccccccccctgcagccagctggcgtaatagcgaagaggcccgcaccgatcgcccttcccaacagttgcgtagcctgaatggcgaatggcgcgacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattttaacaaaatattaacgtttacaatttcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagcattgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctgggctgcaggggggggggggggggggttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctaggatcacgcgttctagatcccatatatggagttccgcgttacataacttacggtaaatggcccgcctggctgaccgcccaac

SEQ ID NO: 43 - DNA, 7006 bp, synthetic construct
  source 1..7006: mol_type = other DNA
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtagacttgcccaaaaactctggcaaagttgaattgcttccaaaagttcaactttatcagaaggacctattccctacggaaactagctgaaggtctcctggcactctggatctcgtggaagggagccttcttcagggaacagagggagcgattaagtggtgaaaagcaaacagacctggaaaagttccctttctgagagtagcaacagaaagctctgcaaagactccctccaagctattggatcctcttgcttgggataaccacttgagtactcagataccaaaagaagagtggaaatcccaagagaagtcaccagaaaaaacagcttttaagaaaaaggatacacttttgtccctgaacgcttgtgaaagcaatctgacaatagcagcaattgaaaagggacaaaataagcccgaaatagaagtcacctgggcaaagcaaggtaggactgaaaggctgtgctctcaaaacccaccagtcttgaaacgcactcaacgggtgaaagtagtaggaaagggtgaatttacaaaggacgtaggactcaaagagtgagtttttccaagcagcagaaacctatttcttactaacttggataatttactgaaaaataatacacacaatcaagaaaaaaaaattcaggaagaaatagaaaagaaggaaaacttaatccaagagtgaatagttttgcctcagataactacagtgactggcactaagaatttctgaaagaaccttttcttactgagcactaggctgaaaatagaaggttacttgaacggggacttgactccagtacttcaagattttaggtactttgaaaattcaacaaatagaacaaagaaacacacagctactttctcaaaaaaaggggaggaagaaaacttggaaggcttgggaaatcaaaccaagcaaattgtagagaaattgactgacaccacaaggatatctcctaatacaagccagcagaattttgtcacgcaacgtagtaagagagctttgaaactagatcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcggccgggcccagcaccccaaggcggccaacgccaaaactctcccccctcctcttcctcaatctcgctctcgctctttttttttttcgcaaaaggaggggagagggggtaaaaaaatgctgcactgtgcggcgaagccggtgagtgagcggcgcggggccaatcagcgtgcgccgttccgaaagttgccttttatggctcgagcggccggccgcggcggcgccctataaaacccagcggcgcgacgcgccaccaccgccgagaccgcgtccgccccgcgagcacagagcctcgcctttgccgatccgccgcccgtccacacccgccgccaggtaagcccggccagccgaccggggcaggcggctcacggcccggccgcaggcggccgccaccggtgccaccatggccttgctcatccacctcaagacagtctcggagctgcggggcaggggcgaccggatcgccaaagtgactttccgagggcaatccttctactctcgggtcctggagaactgtgaggatgtggctgactttgatgagacatttcggtggccggtggccagcagcatcgacagaaatgagatgctggagattcaggttttcaactacagcaaagtcttcagcaacaagctcatcgggaccttccgcatggtgctgcagaaggtggtagaggagagccatgtggaggtgactgacacgctgattgatgacaacaatgctatcatcaagaccagcctgtgcgtggaggtccggtatcaggccactgacggcacagtgggctcctgggacgatggggacttcctgggagatgagtctcttcaagaggaagagaaggacagccaagagacggatggactgctcccaggctcccggcccagctcccggcccccaggagagaagagcttccggagagccgggaggagcgtgttctccgccatgaagctcggcaaaaaccggtctcacaaggaggagccccaaagaccagatgaaccggcggtgctggagatggaagaccttgaccatctggccattcggctaggagatggactggatcccgactcggtgtctctagcctcagtcacagctctcaccactaatgtctccaacaagcgatctaagccagacattaagatggagccaagtgctgggcggcccatggattaccaggtcagcatcacggtgatcgaggcccggcagctggtgggcttgaacatggaccctgtggtgtgcgtggaggtgggtgacgacaagaagtacacatccatgaaggagtccactaactgcccctattacaacgagtacttcgtcttcgacttccatgtctctccggatgtcatgtttgacaagatcatcaagatttcggtgattcactccaagaacctgctgcgcagtggcaccctggtgggctccttcaaaatggacgtgggaaccgtgtactcgcagccagagcaccagttccatcacaagtgggccatcctgtctgaccccgatgacatctcctcggggctgaagggctacgtgaagtgtgacgttgccgtggtgggcaaaggggacaacatcaagacgccccacaaggccaatgagaccgacgaagatgacattgaggggaacttgctgctccccgagggggtgccccccgaacgccagtgggcccggttctatgtgaaaatttaccgagcagaggggctgccccgtatgaacacaagcctcatggccaatgtaaagaaggctttcatcggtgaaaacaaggacctcgtggacccctacgtgcaagtcttctttgctggccagaagggcaagacttcagtgcagaagagcagctatgagcccctgtggaatgagcaggtcgtctttacagacctcttccccccactctgcaaacgcatgaaggtgcagatccgagactcggacaaggtcaacgacgtggccatcggcacccacttcattgacctgcgcaagatttctaatgacggagacaaaggcttcctgcccacactgggcccagcctgggtgaacatgtacggctccacacgtaactacacgctgctggatgagcatcaggacctgaacgagggcctgggggagggtgtgtccttccgggcccggctcctgctgggcctggctgtggagatcgtagacacctccaaccctgagctcaccagctccacagaggtgcaggtggagcaggccacgcccatctcggagagctgtgcaggtaaaatggaagaattctttctctttggagccttcctggaggcctcaatgatcgaccggagaaacggagacaagcccatcacctttgaggtcaccataggcaactatgggaacgaagttgatggcctgtcccggccccagcggcctcggccccggaaggagccgggggatgaggaagaagtagacctgattcagaacgcaagtgatgacgaggccggtgatgccggggacctggcctcagtctcctccactccaccaatgcggccccaggtcaccgacaggaactacttccatctgccctacctggagcgaaagccctgcatctacatcaagagctggtggccggaccagcgccgccgcctctacaatgccaacatcatggaccacattgccgacaagctggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgaggtaagtatcaaggttacaagacaggtttaaggagaccaatagaaactgggcttgtcgagacagagaagactcttgcgtttctaagcttcctaggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 44 - DNA, 6925 bp, synthetic construct
  source 1..6925: mol_type = other DNA
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgataggcacctattggtcttactgacatccactttgcctttctctccacagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacggtcaggcttctccggcgctgccgtgtgctgtgcaatgggggctcctcctctcactccacaggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaactagtgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcaattcagactcccactagaagaaacagaacttgaaaaaaggataattgtggtgaacacctcaacccagtggtccaaaaactgaaaaactttgaccccgagcaccctcacacagatagactactgaaagaaggagaaaggggcacttactcagtctcccttatcagattgccttacgaggagtactagactccctcaagcaaatagatctcacttaccacttgcaaaggtatactactttcactctattagacctatatatctgaccagggtcctattccaagacaactcttctactcttccagcagactcttatagaaagaaagattctggggtccaagaaagcagtactttcttacaaggagccaaaaaaaataacctttctttagcacttctaaccttggagtgaactggtgatcaaagagaggttggctccctggggacaagtgccacaaattcagtcaactacaagaaagttgagaacactgttctcccgaaaccaagcttcctaggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 45 - DNA, 7083 bp, synthetic construct
  source 1..7083: mol_type = other DNA
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtagacttgcccaaaaactctggcaaagttgaattgcttccaaaagttcaactttatcagaaggacctattccctacggaaactagctgaaggtctcctggcactctggatctcgtggaagggagccttcttcagggaacagagggagcgattaagtggtgaaaagcaaacagacctggaaaagttccctttctgagagtagcaacagaaagctctgcaaagactccctccaagctattggatcctcttgcttgggataaccacttgagtactcagataccaaaagaagagtggaaatcccaagagaagtcaccagaaaaaacagcttttaagaaaaaggatacacttttgtccctgaacgcttgtgaaagcaatctgacaatagcagcaattgaaaagggacaaaataagcccgaaatagaagtcacctgggcaaagcaaggtaggactgaaaggctgtgctctcaaaacccaccagtcttgaaacgcactcaacgggtgaaagtagtaggaaagggtgaatttacaaaggacgtaggactcaaagagtgagtttttccaagcagcagaaacctatttcttactaacttggataatttactgaaaaataatacacacaatcaagaaaaaaaaattcaggaagaaatagaaaagaaggaaaacttaatccaagagtgaatagttttgcctcagataactacagtgactggcactaagaatttctgaaagaaccttttcttactgagcactaggctgaaaatagaaggttacttgaacggggacttgactccagtacttcaagattttaggtactttgaaaattcaacaaatagaacaaagaaacacacagctactttctcaaaaaaaggggaggaagaaaacttggaaggcttgggaaatcaaaccaagcaaattgtagagaaattgactgacaccacaaggatatctcctaatacaagccagcagaattttgtcacgcaacgtagtaagagagctttgaaactagatcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcggccgggcccagcaccccaaggcggccaacgccaaaactctcccccctcctcttcctcaatctcgctctcgctctttttttttttcgcaaaaggaggggagagggggtaaaaaaatgctgcactgtgcggcgaagccggtgagtgagcggcgcggggccaatcagcgtgcgccgttccgaaagttgccttttatggctcgagcggccggccgcggcggcgccctataaaacccagcggcgcgacgcgccaccaccgccgagaccgcgtccgccccgcgagcacagagcctcgcctttgccgatccgccgcccgtccacacccgccgccaggtaagcccggccagccgaccggggcaggcggctcacggcccggccgcaggcggccgccaccggtgccaccatggccttgctcatccacctcaagacagtctcggagctgcggggcaggggcgaccggatcgccaaagtgactttccgagggcaatccttctactctcgggtcctggagaactgtgaggatgtggctgactttgatgagacatttcggtggccggtggccagcagcatcgacagaaatgagatgctggagattcaggttttcaactacagcaaagtcttcagcaacaagctcatcgggaccttccgcatggtgctgcagaaggtggtagaggagagccatgtggaggtgactgacacgctgattgatgacaacaatgctatcatcaagaccagcctgtgcgtggaggtccggtatcaggccactgacggcacagtgggctcctgggacgatggggacttcctgggagatgagtctcttcaagaggaagagaaggacagccaagagacggatggactgctcccaggctcccggcccagctcccggcccccaggagagaagagcttccggagagccgggaggagcgtgttctccgccatgaagctcggcaaaaaccggtctcacaaggaggagccccaaagaccagatgaaccggcggtgctggagatggaagaccttgaccatctggccattcggctaggagatggactggatcccgactcggtgtctctagcctcagtcacagctctcaccactaatgtctccaacaagcgatctaagccagacattaagatggagccaagtgctgggcggcccatggattaccaggtcagcatcacggtgatcgaggcccggcagctggtgggcttgaacatggaccctgtggtgtgcgtggaggtgggtgacgacaagaagtacacatccatgaaggagtccactaactgcccctattacaacgagtacttcgtcttcgacttccatgtctctccggatgtcatgtttgacaagatcatcaagatttcggtgattcactccaagaacctgctgcgcagtggcaccctggtgggctccttcaaaatggacgtgggaaccgtgtactcgcagccagagcaccagttccatcacaagtgggccatcctgtctgaccccgatgacatctcctcggggctgaagggctacgtgaagtgtgacgttgccgtggtgggcaaaggggacaacatcaagacgccccacaaggccaatgagaccgacgaagatgacattgaggggaacttgctgctccccgagggggtgccccccgaacgccagtgggcccggttctatgtgaaaatttaccgagcagaggggctgccccgtatgaacacaagcctcatggccaatgtaaagaaggctttcatcggtgaaaacaaggacctcgtggacccctacgtgcaagtcttctttgctggccagaagggcaagacttcagtgcagaagagcagctatgagcccctgtggaatgagcaggtcgtctttacagacctcttccccccactctgcaaacgcatgaaggtgcagatccgagactcggacaaggtcaacgacgtggccatcggcacccacttcattgacctgcgcaagatttctaatgacggagacaaaggcttcctgcccacactgggcccagcctgggtgaacatgtacggctccacacgtaactacacgctgctggatgagcatcaggacctgaacgagggcctgggggagggtgtgtccttccgggcccggctcctgctgggcctggctgtggagatcgtagacacctccaaccctgagctcaccagctccacagaggtgcaggtggagcaggccacgcccatctcggagagctgtgcaggtaaaatggaagaattctttctctttggagccttcctggaggcctcaatgatcgaccggagaaacggagacaagcccatcacctttgaggtcaccataggcaactatgggaacgaagttgatggcctgtcccggccccagcggcctcggccccggaaggagccgggggatgaggaagaagtagacctgattcagaacgcaagtgatgacgaggccggtgatgccggggacctggcctcagtctcctccactccaccaatgcggccccaggtcaccgacaggaactacttccatctgccctacctggagcgaaagccctgcatctacatcaagagctggtggccggaccagcgccgccgcctctacaatgccaacatcatggaccacattgccgacaagctggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgaggtaagtatcaaggttacaagacaggtttaaggagaccaatagaaactgggcttgtcgagacagagaagactcttgcgtttctgggattttgccgatttcggcctattggttaaaaaatgagctgatttaacaaaaatttaacgcgaattttaacaaaataagcttcctaggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 46 - DNA, 7059 bp, synthetic construct
  source 1..7059: mol_type = other DNA
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtagacttgcccaaaaactctggcaaagttgaattgcttccaaaagttcaactttatcagaaggacctattccctacggaaactagctgaaggtctcctggcactctggatctcgtggaagggagccttcttcagggaacagagggagcgattaagtggtgaaaagcaaacagacctggaaaagttccctttctgagagtagcaacagaaagctctgcaaagactccctccaagctattggatcctcttgcttgggataaccacttgagtactcagataccaaaagaagagtggaaatcccaagagaagtcaccagaaaaaacagcttttaagaaaaaggatacacttttgtccctgaacgcttgtgaaagcaatctgacaatagcagcaattgaaaagggacaaaataagcccgaaatagaagtcacctgggcaaagcaaggtaggactgaaaggctgtgctctcaaaacccaccagtcttgaaacgcactcaacgggtgactagatcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcggccgggcccagcaccccaaggcggccaacgccaaaactctcccccctcctcttcctcaatctcgctctcgctctttttttttttcgcaaaaggaggggagagggggtaaaaaaatgctgcactgtgcggcgaagccggtgagtgagcggcgcggggccaatcagcgtgcgccgttccgaaagttgccttttatggctcgagcggccggccgcggcggcgccctataaaacccagcggcgcgacgcgccaccaccgccgagaccgcgtccgccccgcgagcacagagcctcgcctttgccgatccgccgcccgtccacacccgccgccaggtaagcccggccagccgaccggggcaggcggctcacggcccggccgcaggcggccgccaccggtgccaccatggccttgctcatccacctcaagacagtctcggagctgcggggcaggggcgaccggatcgccaaagtgactttccgagggcaatccttctactctcgggtcctggagaactgtgaggatgtggctgactttgatgagacatttcggtggccggtggccagcagcatcgacagaaatgagatgctggagattcaggttttcaactacagcaaagtcttcagcaacaagctcatcgggaccttccgcatggtgctgcagaaggtggtagaggagagccatgtggaggtgactgacacgctgattgatgacaacaatgctatcatcaagaccagcctgtgcgtggaggtccggtatcaggccactgacggcacagtgggctcctgggacgatggggacttcctgggagatgagtctcttcaagaggaagagaaggacagccaagagacggatggactgctcccaggctcccggcccagctcccggcccccaggagagaagagcttccggagagccgggaggagcgtgttctccgccatgaagctcggcaaaaaccggtctcacaaggaggagccccaaagaccagatgaaccggcggtgctggagatggaagaccttgaccatctggccattcggctaggagatggactggatcccgactcggtgtctctagcctcagtcacagctctcaccactaatgtctccaacaagcgatctaagccagacattaagatggagccaagtgctgggcggcccatggattaccaggtcagcatcacggtgatcgaggcccggcagctggtgggcttgaacatggaccctgtggtgtgcgtggaggtgggtgacgacaagaagtacacatccatgaaggagtccactaactgcccctattacaacgagtacttcgtcttcgacttccatgtctctccggatgtcatgtttgacaagatcatcaagatttcggtgattcactccaagaacctgctgcgcagtggcaccctggtgggctccttcaaaatggacgtgggaaccgtgtactcgcagccagagcaccagttccatcacaagtgggccatcctgtctgaccccgatgacatctcctcggggctgaagggctacgtgaagtgtgacgttgccgtggtgggcaaaggggacaacatcaagacgccccacaaggccaatgagaccgacgaagatgacattgaggggaacttgctgctccccgagggggtgccccccgaacgccagtgggcccggttctatgtgaaaatttaccgagcagaggggctgccccgtatgaacacaagcctcatggccaatgtaaagaaggctttcatcggtgaaaacaaggacctcgtggacccctacgtgcaagtcttctttgctggccagaagggcaagacttcagtgcagaagagcagctatgagcccctgtggaatgagcaggtcgtctttacagacctcttccccccactctgcaaacgcatgaaggtgcagatccgagactcggacaaggtcaacgacgtggccatcggcacccacttcattgacctgcgcaagatttctaatgacggagacaaaggcttcctgcccacactgggcccagcctgggtgaacatgtacggctccacacgtaactacacgctgctggatgagcatcaggacctgaacgagggcctgggggagggtgtgtccttccgggcccggctcctgctgggcctggctgtggagatcgtagacacctccaaccctgagctcaccagctccacagaggtgcaggtggagcaggccacgcccatctcggagagctgtgcaggtaaaatggaagaattctttctctttggagccttcctggaggcctcaatgatcgaccggagaaacggagacaagcccatcacctttgaggtcaccataggcaactatgggaacgaagttgatggcctgtcccggccccagcggcctcggccccggaaggagccgggggatgaggaagaagtagacctgattcagaacgcaagtgatgacgaggccggtgatgccggggacctggcctcagtctcctccactccaccaatgcggccccaggtcaccgacaggaactacttccatctgccctacctggagcgaaagccctgcatctacatcaagagctggtggccggaccagcgccgccgcctctacaatgccaacatcatggaccacattgccgacaagctggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgaggtaagtatcaaggttacaagacaggttatcagtctgattgcggcgttagcggtagatcacgttatcggcatggaaaccgtcatgccgtggaacctgcctgccgatctcgcctggtttaaacgcaacaccttaaataaacccgtgattatgggccgccatacctgggaatcaatcggtcgtccgttgccaggacgcaaaaatattatcctcagcagtcaaccgagtacggacgatcgcgtaacgtgggtgaagtcggtggatgaagccatcgcggcgtgtggtgacgtaccagaaatcatggttattggcggcggtcgcgtttatgaacagttcttgccaaaagcgcaaaaactgtatctgacgcatatcgacgcagaagtggaaggcgacacccatttcccggattacgagccggatgactgggaatcggtattcagcgaattccacgatgctgatgcgcagaactctcacagctattgctttgagattctggagcggcgatgataaggagaccaatagaaactgggcttgtcgagacagagaagactcttgcgtttctgggattttgccgatttcggcctattggttaaaaaatgagctgatttaacaaaaatttaacgcgaattttaacaaaatagcttcctaggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 47 - DNA, 7002 bp, synthetic construct
  source 1..7002: mol_type = other DNA
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgggattttgccgatttcggcctattggttaaaaaatgagctgatttaacaaaaatttaacgcgaattttaacaaaatgataggcacctattggtcttactgacatccactttgcctttctctccacagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacggtcaggcttctccggcgctgccgtgtgctgtgcaatgggggctcctcctctcactccacaggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaactagtgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcaattcagactcccactagaagaaacagaacttgaaaaaaggataattgtggtgaacacctcaacccagtggtccaaaaactgaaaaactttgaccccgagcaccctcacacagatagactactgaaagaaggagaaaggggcacttactcagtctcccttatcagattgccttacgaggagtactagactccctcaagcaaatagatctcacttaccacttgcaaaggtatactactttcactctattagacctatatatctgaccagggtcctattccaagacaactcttctactcttccagcagactcttatagaaagaaagattctggggtccaagaaagcagtactttcttacaaggagccaaaaaaaataacctttctttagcacttctaaccttggagtgaactggtgatcaaagagaggttggctccctggggacaagtgccacaaattcagtcaactacaagaaagttgagaacactgttctcccgaaaccaagcttcctaggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 48 - DNA, 7761 bp, synthetic construct
  source 1..7761: mol_type = other DNA
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgggattttgccgatttcggcctattggttaaaaaatgagctgatttaacaaaaatttaacgcgaattttaacaaaatgataggcacctattggtcttactgacatccactttgcctttctctccacagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacggtcaggcttctccggcgctgccgtgtgctgtgcaatgggggctcctcctctcactccacaggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcaggctccggagagggcagaggaagtctgctaacatgcggtgacgtcgaggagaatcctggcccaatggagagcgacgagagcggcctgcccgccatggagatcgagtgccgcatcaccggcaccctgaacggcgtggagttcgagctggtgggcggcggagagggcacccccgagcagggccgcatgaccaacaagatgaagagcaccaaaggcgccctgaccttcagcccctacctgctgagccacgtgatgggctacggcttctaccacttcggcacctaccccagcggctacgagaaccccttcctgcacgccatcaacaacggcggctacaccaacacccgcatcgagaagtacgaggacggcggcgtgctgcacgtgagcttcagctaccgctacgaggccggccgcgtgatcggcgacttcaaggtgatgggcaccggcttccccgaggacagcgtgatcttcaccgacaagatcatccgcagcaacgccaccgtggagcacctgcaccccatgggcgataacgatctggatggcagcttcacccgcaccttcagcctgcgcgacggcggctactacagctccgtggtggacagccacatgcacttcaagagcgccatccaccccagcatcctgcagaacgggggccccatgttcgccttccgccgcgtggaggaggatcacagcaacaccgagctgggcatcgtggagtaccagcacgccttcaagaccccggatgcagatgccggtgaagaataaactagtgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcaattcagactcccactagaagaaacagaacttgaaaaaaggataattgtggtgaacacctcaacccagtggtccaaaaactgaaaaactttgaccccgagcaccctcacacagatagactactgaaagaaggagaaaggggcacttactcagtctcccttatcagattgccttacgaggagtactagactccctcaagcaaatagatctcacttaccacttgcaaaggtatactactttcactctattagacctatatatctgaccagggtcctattccaagacaactcttctactcttccagcagactcttatagaaagaaagattctggggtccaagaaagcagtactttcttacaaggagccaaaaaaaataacctttctttagcacttctaaccttggagtgaactggtgatcaaagagaggttggctccctggggacaagtgccacaaattcagtcaactacaagaaagttgagaacactgttctcccgaaaccaagcttcctaggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 49 - DNA, 6878 bp, synthetic construct
  source 1..6878: mol_type = other DNA
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtctagatcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcggccgggcccagcaccccaaggcggccaacgccaaaactctcccccctcctcttcctcaatctcgctctcgctctttttttttttcgcaaaaggaggggagagggggtaaaaaaatgctgcactgtgcggcgaagccggtgagtgagcggcgcggggccaatcagcgtgcgccgttccgaaagttgccttttatggctcgagcggccggccgcggcggcgccctataaaacccagcggcgcgacgcgccaccaccgccgagaccgcgtccgccccgcgagcacagagcctcgcctttgccgatccgccgcccgtccacacccgccgccaggtaagcccggccagccgaccggggcaggcggctcacggcccggccgcaggcggccgccaccggtgccaccatggccttgctcatccacctcaagacagtctcggagctgcggggcaggggcgaccggatcgccaaagtgactttccgagggcaatccttctactctcgggtcctggagaactgtgaggatgtggctgactttgatgagacatttcggtggccggtggccagcagcatcgacagaaatgagatgctggagattcaggttttcaactacagcaaagtcttcagcaacaagctcatcgggaccttccgcatggtgctgcagaaggtggtagaggagagccatgtggaggtgactgacacgctgattgatgacaacaatgctatcatcaagaccagcctgtgcgtggaggtccggtatcaggccactgacggcacagtgggctcctgggacgatggggacttcctgggagatgagtctcttcaagaggaagagaaggacagccaagagacggatggactgctcccaggctcccggcccagctcccggcccccaggagagaagagcttccggagagccgggaggagcgtgttctccgccatgaagctcggcaaaaaccggtctcacaaggaggagccccaaagaccagatgaaccggcggtgctggagatggaagaccttgaccatctggccattcggctaggagatggactggatcccgactcggtgtctctagcctcagtcacagctctcaccactaatgtctccaacaagcgatctaagccagacattaagatggagccaagtgctgggcggcccatggattaccaggtcagcatcacggtgatcgaggcccggcagctggtgggcttgaacatggaccctgtggtgtgcgtggaggtgggtgacgacaagaagtacacatccatgaaggagtccactaactgcccctattacaacgagtacttcgtcttcgacttccatgtctctccggatgtcatgtttgacaagatcatcaagatttcggtgattcactccaagaacctgctgcgcagtggcaccctggtgggctccttcaaaatggacgtgggaaccgtgtactcgcagccagagcaccagttccatcacaagtgggccatcctgtctgaccccgatgacatctcctcggggctgaagggctacgtgaagtgtgacgttgccgtggtgggcaaaggggacaacatcaagacgccccacaaggccaatgagaccgacgaagatgacattgaggggaacttgctgctccccgagggggtgccccccgaacgccagtgggcccggttctatgtgaaaatttaccgagcagaggggctgccccgtatgaacacaagcctcatggccaatgtaaagaaggctttcatcggtgaaaacaaggacctcgtggacccctacgtgcaagtcttctttgctggccagaagggcaagacttcagtgcagaagagcagctatgagcccctgtggaatgagcaggtcgtctttacagacctcttccccccactctgcaaacgcatgaaggtgcagatccgagactcggacaaggtcaacgacgtggccatcggcacccacttcattgacctgcgcaagatttctaatgacggagacaaaggcttcctgcccacactgggcccagcctgggtgaacatgtacggctccacacgtaactacacgctgctggatgagcatcaggacctgaacgagggcctgggggagggtgtgtccttccgggcccggctcctgctgggcctggctgtggagatcgtagacacctccaaccctgagctcaccagctccacagaggtgcaggtggagcaggccacgcccatctcggagagctgtgcaggtaaaatggaagaattctttctctttggagccttcctggaggcctcaatgatcgaccggagaaacggagacaagcccatcacctttgaggtcaccataggcaactatgggaacgaagttgatggcctgtcccggccccagcggcctcggccccggaaggagccgggggatgaggaagaagtagacctgattcagaacgcaagtgatgacgaggccggtgatgccggggacctggcctcagtctcctccactccaccaatgcggccccaggtcaccgacaggaactacttccatctgccctacctggagcgaaagccctgcatctacatcaagagctggtggccggaccagcgccgccgcctctacaatgccaacatcatggaccacattgccgacaagctggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgaggtaagtatcaaggttacaagacaggtttaaggagaccaatagaaactgggcttgtcgagacagagaagactcttgcgtttctctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtatgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccggggcgaagcttcctaggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 50 - DNA, 7297 bp, synthetic construct
  source 1..7297: mol_type = other DNA
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtatgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccggggcggataggcacctattggtcttactgacatccactttgcctttctctccacagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacggtcaggcttctccggcgctgccgtgtgctgtgcaatgggggctcctcctctcactccacaggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaactagtgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggaagcttcctaggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 51 - DNA, 6905 bp, synthetic construct
  source 1..6905: mol_type = other DNA
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtagacttgcccaaaaactctggcaaagttgaattgcttccaaaagttcaactttatcagaaggacctattccctacggaaactagctgaaggtctcctggcactctggatctcgtggaagggagccttcttcagggaacagagggagcgattaagtggtgaaaagcaaacagacctggaaaagttccctttctgagagtagcaacagaaagctctgcaaagactccctccaagctattggatcctcttgcttgggataaccacttgagtactcagataccaaaagaagagtggaaatcccaagagaagtcaccagaaaaaacagcttttaagaaaaaggatacacttttgtccctgaacgcttgtgaaagcaatctgacaatagcagcaattgaaaagggacaaaataagcccgaaatagaagtcacctgggcaaagcaaggtaggactgaaaggctgtgctctcaaaacccaccagtcttgaaacgcactcaacgggtgaaagtagtaggaaagggtgaatttacaaaggacgtaggactcaaagagtgagtttttccaagcagcagaaacctatttcttactaacttggataatttactgaaaaataatacacacaatcaagaaaaaaaaattcaggaagaaatagaaaagaaggaaaacttaatccaagagtgaatagttttgcctcagataactacagtgactggcactaagaatttctgaaagaaccttttcttactgagcactaggctgaaaatagaaggttacttgaacggggacttgactccagtacttcaagattttaggtactttgaaaattcaacaaatagaacaaagaaacacacagctactttctcaaaaaaaggggaggaagaaaacttggaaggcttgggaaatcaaaccaagcaaattgtagagaaattgactgacaccacaaggatatctcctaatacaagccagcagaattttgtcacgcaacgtagtaagagagctttgaaactagatcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtggccgccaccggtgccaccatggccttgctcatccacctcaagacagtctcggagctgcggggcaggggcgaccggatcgccaaagtgactttccgagggcaatccttctactctcgggtcctggagaactgtgaggatgtggctgactttgatgagacatttcggtggccggtggccagcagcatcgacagaaatgagatgctggagattcaggttttcaactacagcaaagtcttcagcaacaagctcatcgggaccttccgcatggtgctgcagaaggtggtagaggagagccatgtggaggtgactgacacgctgattgatgacaacaatgctatcatcaagaccagcctgtgcgtggaggtccggtatcaggccactgacggcacagtgggctcctgggacgatggggacttcctgggagatgagtctcttcaagaggaagagaaggacagccaagagacggatggactgctcccaggctcccggcccagctcccggcccccaggagagaagagcttccggagagccgggaggagcgtgttctccgccatgaagctcggcaaaaaccggtctcacaaggaggagccccaaagaccagatgaaccggcggtgctggagatggaagaccttgaccatctggccattcggctaggagatggactggatcccgactcggtgtctctagcctcagtcacagctctcaccactaatgtctccaacaagcgatctaagccagacattaagatggagccaagtgctgggcggcccatggattaccaggtcagcatcacggtgatcgaggcccggcagctggtgggcttgaacatggaccctgtggtgtgcgtggaggtgggtgacgacaagaagtacacatccatgaaggagtccactaactgcccctattacaacgagtacttcgtcttcgacttccatgtctctccggatgtcatgtttgacaagatcatcaagatttcggtgattcactccaagaacctgctgcgcagtggcaccctggtgggctccttcaaaatggacgtgggaaccgtgtactcgcagccagagcaccagttccatcacaagtgggccatcctgtctgaccccgatgacatctcctcggggctgaagggctacgtgaagtgtgacgttgccgtggtgggcaaaggggacaacatcaagacgccccacaaggccaatgagaccgacgaagatgacattgaggggaacttgctgctccccgagggggtgccccccgaacgccagtgggcccggttctatgtgaaaatttaccgagcagaggggctgccccgtatgaacacaagcctcatggccaatgtaaagaaggctttcatcggtgaaaacaaggacctcgtggacccctacgtgcaagtcttctttgctggccagaagggcaagacttcagtgcagaagagcagctatgagcccctgtggaatgagcaggtcgtctttacagacctcttccccccactctgcaaacgcatgaaggtgcagatccgagactcggacaaggtcaacgacgtggccatcggcacccacttcattgacctgcgcaagatttctaatgacggagacaaaggcttcctgcccacactgggcccagcctgggtgaacatgtacggctccacacgtaactacacgctgctggatgagcatcaggacctgaacgagggcctgggggagggtgtgtccttccgggcccggctcctgctgggcctggctgtggagatcgtagacacctccaaccctgagctcaccagctccacagaggtgcaggtggagcaggccacgcccatctcggagagctgtgcaggtaaaatggaagaattctttctctttggagccttcctggaggcctcaatgatcgaccggagaaacggagacaagcccatcacctttgaggtcaccataggcaactatgggaacgaagttgatggcctgtcccggccccagcggcctcggccccggaaggagccgggggatgaggaagaagtagacctgattcagaacgcaagtgatgacgaggccggtgatgccggggacctggcctcagtctcctccactccaccaatgcggccccaggtcaccgacaggaactacttccatctgccctacctggagcgaaagccctgcatctacatcaagagctggtggccggaccagcgccgccgcctctacaatgccaacatcatggaccacattgccgacaagctggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgaggtaagtatcaaggttacaagacaggtttaaggagaccaatagaaactgggcttgtcgagacagagaagactcttgcgtttctgggattttgccgatttcggcctattggttaaaaaatgagctgatttaacaaaaatttaacgcgaattttaacaaaataagcttcctaggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 52 - DNA, 7056 bp, synthetic construct
  source 1..7056: mol_type = other DNA
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgggccgccaccggtgccaccatggccttgctcatccacctcaagacagtctcggagctgcggggcaggggcgaccggatcgccaaagtgactttccgagggcaatccttctactctcgggtcctggagaactgtgaggatgtggctgactttgatgagacatttcggtggccggtggccagcagcatcgacagaaatgagatgctggagattcaggttttcaactacagcaaagtcttcagcaacaagctcatcgggaccttccgcatggtgctgcagaaggtggtagaggagagccatgtggaggtgactgacacgctgattgatgacaacaatgctatcatcaagaccagcctgtgcgtggaggtccggtatcaggccactgacggcacagtgggctcctgggacgatggggacttcctgggagatgagtctcttcaagaggaagagaaggacagccaagagacggatggactgctcccaggctcccggcccagctcccggcccccaggagagaagagcttccggagagccgggaggagcgtgttctccgccatgaagctcggcaaaaaccggtctcacaaggaggagccccaaagaccagatgaaccggcggtgctggagatggaagaccttgaccatctggccattcggctaggagatggactggatcccgactcggtgtctctagcctcagtcacagctctcaccactaatgtctccaacaagcgatctaagccagacattaagatggagccaagtgctgggcggcccatggattaccaggtcagcatcacggtgatcgaggcccggcagctggtgggcttgaacatggaccctgtggtgtgcgtggaggtgggtgacgacaagaagtacacatccatgaaggagtccactaactgcccctattacaacgagtacttcgtcttcgacttccatgtctctccggatgtcatgtttgacaagatcatcaagatttcggtgattcactccaagaacctgctgcgcagtggcaccctggtgggctccttcaaaatggacgtgggaaccgtgtactcgcagccagagcaccagttccatcacaagtgggccatcctgtctgaccccgatgacatctcctcggggctgaagggctacgtgaagtgtgacgttgccgtggtgggcaaaggggacaacatcaagacgccccacaaggccaatgagaccgacgaagatgacattgaggggaacttgctgctccccgagggggtgccccccgaacgccagtgggcccggttctatgtgaaaatttaccgagcagaggggctgccccgtatgaacacaagcctcatggccaatgtaaagaaggctttcatcggtgaaaacaaggacctcgtggacccctacgtgcaagtcttctttgctggccagaagggcaagacttcagtgcagaagagcagctatgagcccctgtggaatgagcaggtcgtctttacagacctcttccccccactctgcaaacgcatgaaggtgcagatccgagactcggacaaggtcaacgacgtggccatcggcacccacttcattgacctgcgcaagatttctaatgacggagacaaaggcttcctgcccacactgggcccagcctgggtgaacatgtacggctccacacgtaactacacgctgctggatgagcatcaggacctgaacgagggcctgggggagggtgtgtccttccgggcccggctcctgctgggcctggctgtggagatcgtagacacctccaaccctgagctcaccagctccacagaggtgcaggtggagcaggccacgcccatctcggagagctgtgcaggtaaaatggaagaattctttctctttggagccttcctggaggcctcaatgatcgaccggagaaacggagacaagcccatcacctttgaggtcaccataggcaactatgggaacgaagttgatggcctgtcccggccccagcggcctcggccccggaaggagccgggggatgaggaagaagtagacctgattcagaacgcaagtgatgacgaggccggtgatgccggggacctggcctcagtctcctccactccaccaatgcggccccaggtcaccgacaggaactacttccatctgccctacctggagcgaaagccctgcatctacatcaagagctggtggccggaccagcgccgccgcctctacaatgccaacatcatggaccacattgccgacaagctggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgaggtaagtatcaaggttacaagacaggtttaaggagaccaatagaaactgggcttgtcgagacagagaagactcttgcgtttctgggattttgccgatttcggcctattggttaaaaaatgagctgatttaacaaaaatttaacgcgaattttaacaaaataagcttcctaggaccgagcggccgcaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcaggggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgt

SEQ ID NO: 53 - protein, 158 aa, Escherichia coli
ISLIAALAVDHVIGMETVMPWNLPADLAWFKRNTLNKPVIMGRHTWESIGRPLPGRKNIILSSQPSTDDRVTWVKSVDEAIAACGDVPEIMVIGGGRVYEQFLPKAQKLYLTHIDAEVEGDTHFPDYEPDDWESVFSEFHDADAQNSHSYCFEILERR

SEQ ID NO: 54 - DNA, 500 bp, Homo sapiens
  source 1..500: mol_type = genomic DNA
agacttgcccaaaaactctggcaaagttgaattgcttccaaaagttcaactttatcagaaggacctattccctacggaaactagctgaaggtctcctggcactctggatctcgtggaagggagccttcttcagggaacagagggagcgattaagtggtgaaaagcaaacagacctggaaaagttccctttctgagagtagcaacagaaagctctgcaaagactccctccaagctattggatcctcttgcttgggataaccacttgagtactcagataccaaaagaagagtggaaatcccaagagaagtcaccagaaaaaacagcttttaagaaaaaggatacacttttgtccctgaacgcttgtgaaagcaatctgacaatagcagcaattgaaaagggacaaaataagcccgaaatagaagtcacctgggcaaagcaaggtaggactgaaaggctgtgctctcaaaacccaccagtcttgaaacgcactcaacgggtga

SEQ ID NO: 55 - DNA, 500 bp, Homo sapiens
  source 1..500: mol_type = genomic DNA
aagtagtaggaaagggtgaatttacaaaggacgtaggactcaaagagtgagtttttccaagcagcagaaacctatttcttactaacttggataatttactgaaaaataatacacacaatcaagaaaaaaaaattcaggaagaaatagaaaagaaggaaaacttaatccaagagtgaatagttttgcctcagataactacagtgactggcactaagaatttctgaaagaaccttttcttactgagcactaggctgaaaatagaaggttacttgaacggggacttgactccagtacttcaagattttaggtactttgaaaattcaacaaatagaacaaagaaacacacagctactttctcaaaaaaaggggaggaagaaaacttggaaggcttgggaaatcaaaccaagcaaattgtagagaaattgactgacaccacaaggatatctcctaatacaagccagcagaattttgtcacgcaacgtagtaagagagctttgaaa

SEQ ID NO: 56 - DNA, 500 bp, Homo sapiens
  source 1..500: mol_type = genomic DNA
gttgactaaagattgaaccttattcaaagttagactctctttgttaaagacaaacaaaacttccaataattcagcaactaatagaaagactcaacttgtgagccactacttattaattgagaatagtcactcagtctggcaaaatatattagaaagtgacactgagtttaaaaaagtgacacctttgattctgaacagtgaactttgagactgaaaaactacagctttgaggctaaatacttgatcaaataaaactacttactcaaaaaactgagtgaaagtccaacagaaaaaagagggcccacttccaccagtgacacaaaatccagattgatcgttctttaagtgactattcttgccagaatcagcaaggtggatacaaaggactctgagaaagaactctctgaactctgggcaaggccccagtccaaagcaattagtatccttaggaccagaaaaatctgtggaaggtcagaatttcttgtctgagaaaaacaaag

SEQ ID NO: 57 - DNA, 500 bp, Homo sapiens
  source 1..500: mol_type = genomic DNA
caattcagactcccactagaagaaacagaacttgaaaaaaggataattgtggtgaacacctcaacccagtggtccaaaaactgaaaaactttgaccccgagcaccctcacacagatagactactgaaagaaggagaaaggggcacttactcagtctcccttatcagattgccttacgaggagtactagactccctcaagcaaatagatctcacttaccacttgcaaaggtatactactttcactctattagacctatatatctgaccagggtcctattccaagacaactcttctactcttccagcagactcttatagaaagaaagattctggggtccaagaaagcagtactttcttacaaggagccaaaaaaaataacctttctttagcacttctaaccttggagtgaactggtgatcaaagagaggttggctccctggggacaagtgccacaaattcagtcaactacaagaaagttgagaacactgttctcccgaaacc

SEQ ID NO: 58 - DNA, 1000 bp, Homo sapiens
  source 1..1000: mol_type = genomic DNA
agacttgcccaaaaactctggcaaagttgaattgcttccaaaagttcaactttatcagaaggacctattccctacggaaactagctgaaggtctcctggcactctggatctcgtggaagggagccttcttcagggaacagagggagcgattaagtggtgaaaagcaaacagacctggaaaagttccctttctgagagtagcaacagaaagctctgcaaagactccctccaagctattggatcctcttgcttgggataaccacttgagtactcagataccaaaagaagagtggaaatcccaagagaagtcaccagaaaaaacagcttttaagaaaaaggatacacttttgtccctgaacgcttgtgaaagcaatctgacaatagcagcaattgaaaagggacaaaataagcccgaaatagaagtcacctgggcaaagcaaggtaggactgaaaggctgtgctctcaaaacccaccagtcttgaaacgcactcaacgggtgaaagtagtaggaaagggtgaatttacaaaggacgtaggactcaaagagtgagtttttccaagcagcagaaacctatttcttactaacttggataatttactgaaaaataatacacacaatcaagaaaaaaaaattcaggaagaaatagaaaagaaggaaaacttaatccaagagtgaatagttttgcctcagataactacagtgactggcactaagaatttctgaaagaaccttttcttactgagcactaggctgaaaatagaaggttacttgaacggggacttgactccagtacttcaagattttaggtactttgaaaattcaacaaatagaacaaagaaacacacagctactttctcaaaaaaaggggaggaagaaaacttggaaggcttgggaaatcaaaccaagcaaattgtagagaaattgactgacaccacaaggatatctcctaatacaagccagcagaattttgtcacgcaacgtagtaagagagctttgaaa

SEQ ID NO: 59 - DNA, 127 bp, synthetic construct
  source 1..127: mol_type = other DNA
cctgcaggcagctgcgcgctcgctcgctcactgaggccgcccgggcgtcgggcgacctttggtcgcccggcctcagtgagcgagcgagcgcgcagagagggagtggccaactccatcactaggggtt

SEQ ID NO: 60 - DNA, 141 bp, synthetic construct
  source 1..141: mol_type = other DNA
aggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 61 - DNA, 1671 bp, synthetic construct
  source 1..1671: mol_type = other DNA
gacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacag

SEQ ID NO: 62 - DNA, 2667 bp, synthetic construct
  source 1..2667: mol_type = other DNA
atggccttgctcatccacctcaagacagtctcggagctgcggggcaggggcgaccggatcgccaaagtgactttccgagggcaatccttctactctcgggtcctggagaactgtgaggatgtggctgactttgatgagacatttcggtggccggtggccagcagcatcgacagaaatgagatgctggagattcaggttttcaactacagcaaagtcttcagcaacaagctcatcgggaccttccgcatggtgctgcagaaggtggtagaggagagccatgtggaggtgactgacacgctgattgatgacaacaatgctatcatcaagaccagcctgtgcgtggaggtccggtatcaggccactgacggcacagtgggctcctgggacgatggggacttcctgggagatgagtctcttcaagaggaagagaaggacagccaagagacggatggactgctcccaggctcccggcccagctcccggcccccaggagagaagagcttccggagagccgggaggagcgtgttctccgccatgaagctcggcaaaaacaggtctcacaaggaggagccccaaagaccagatgaaccggcggtgctggagatggaagaccttgaccatctggccattcggctaggagatggactggatcccgactcggtgtctctagcctcagtcacagctctcaccactaatgtctccaacaagcgatctaagccagacattaagatggagccaagtgctgggcggcccatggattaccaggtcagcatcacggtgatcgaggcccggcagctggtgggcttgaacatggaccctgtggtgtgcgtggaggtgggtgacgacaagaagtacacatccatgaaggagtccactaactgcccctattacaacgagtacttcgtcttcgacttccatgtctctccggatgtcatgtttgacaagatcatcaagatttcggtgattcactccaagaacctgctgcgcagtggcaccctggtgggctccttcaaaatggacgtgggaaccgtgtactcgcagccagagcaccagttccatcacaagtgggccatcctgtctgaccccgatgacatctcctcggggctgaagggctacgtgaagtgtgacgttgccgtggtgggcaaaggggacaacatcaagacgccccacaaggccaatgagaccgacgaagatgacattgaggggaacttgctgctccccgagggggtgccccccgaacgccagtgggcccggttctatgtgaaaatttaccgagcagaggggctgccccgtatgaacacaagcctcatggccaatgtaaagaaggctttcatcggtgaaaacaaggacctcgtggacccctacgtgcaagtcttctttgctggccagaagggcaagacttcagtgcagaagagcagctatgagcccctgtggaatgagcaggtcgtctttacagacctcttccccccactctgcaaacgcatgaaggtgcagatccgagactcggacaaggtcaacgacgtggccatcggcacccacttcattgacctgcgcaagatttctaatgacggagacaaaggcttcctgcccacactgggcccagcctgggtgaacatgtacggctccacacgtaactacacgctgctggatgagcatcaggacctgaacgagggcctgggggagggtgtgtccttccgggcccggctcctgctgggcctggctgtggagatcgtagacacctccaaccctgagctcaccagctccacagaggtgcaggtggagcaggccacgcccatctcggagagctgtgcaggtaaaatggaagaattctttctctttggagccttcctggaggcctcaatgatcgaccggagaaacggagacaagcccatcacctttgaggtcaccataggcaactatgggaacgaagttgatggcctgtcccggccccagcggcctcggccccggaaggagccgggggatgaggaagaagtagacctgattcagaacgcaagtgatgacgaggccggtgatgccggggacctggcctcagtctcctccactccaccaatgcggccccaggtcaccgacaggaactacttccatctgccctacctggagcgaaagccctgcatctacatcaagagctggtggccggaccagcgccgccgcctctacaatgccaacatcatggaccacattgccgacaagctggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgaggtaagtatcaaggttacaagacaggtttaaggagaccaatagaaactgggcttgtcgagacagagaagactcttgcgtttctgggattttgccgatttcggcctattggttaaaaaatgagctgatttaacaaaaatttaacgc

SEQ ID NO: 63 - DNA, 3471 bp, synthetic construct
  source 1..3471: mol_type = other DNA
ccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacggtcaggcttctccggcgctgccgtgtgctgtgcaatgggggctcctcctctcactccacaggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatga

SEQ ID NO: 64 - DNA, 82 bp, synthetic construct
  source 1..82: mol_type = other DNA
gtaagtatcaaggttacaagacaggtttaaggagaccaatagaaactgggcttgtcgagacagagaagactcttgcgtttct

SEQ ID NO: 65 - DNA, 51 bp, synthetic construct
  source 1..51: mol_type = other DNA
gataggcacctattggtcttactgacatccactttgcctttctctccacag

SEQ ID NO: 66 - DNA, 77 bp, synthetic construct
  source 1..77: mol_type = other DNA
gggattttgccgatttcggcctattggttaaaaaatgagctgatttaacaaaaatttaacgcgaattttaacaaaat

SEQ ID NO: 67 - DNA, 77 bp, synthetic construct; identical to SEQ ID NO: 66
  source 1..77: mol_type = other DNA

SEQ ID NO: 68 - DNA, 240 bp, synthetic construct
  source 1..240: mol_type = other DNA
gctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgg

SEQ ID NO: 69 - DNA, 589 bp, synthetic construct
  source 1..589: mol_type = other DNA
aatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgc

SEQ ID NO: 70 - DNA, 547 bp, synthetic construct
  source 1..547: mol_type = other DNA
ctagatcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgt

SEQ ID NO: 71 - DNA, 48 bp, synthetic construct
  source 1..48: mol_type = other DNA
gcctgcaagaactggttcagcagcctgagccacttcgtgatccacctg

SEQ ID NO: 72 - DNA, 82 bp, synthetic construct
  source 1..82: mol_type = other DNA
gtgaggacgcaactggacggcgggggctggagggagggcctggttgtgagaaggtgtcacaaccccctttgtcatggcccga

SEQ ID NO: 73 - DNA, 45 bp, synthetic construct
  source 1..45: mol_type = other DNA
gctgtcccccagttgctgggttcactgacaccccctccttcgcag

SEQ ID NO: 74 - DNA, 82 bp, synthetic construct
  source 1..82: mol_type = other DNA
gtgcggcccaaggggtcggggctttgcctcatccagggctggctctctggggcccctcaggatcagggggctcaatcaggag

SEQ ID NO: 75 - DNA, 46 bp, synthetic construct
  source 1..46: mol_type = other DNA
gctagacccccttacccactgcccctggccaccccccaacccccag

SEQ ID NO: 76 - DNA, 49 bp, synthetic construct
  source 1..49: mol_type = other DNA
aataaaatatctttattttcattacatctgtgtgttggttttttgtgtg

SEQ ID NO: 77 - DNA, 48 bp, synthetic construct
  source 1..48: mol_type = other DNA
cggcaataaaaagacagaataaaacgcacggtgttgggtcgtttgttc

SEQ ID NO: 78 - protein, 270 aa, Homo sapiens
MVTFATILQVNKVMSILFYVIFLAYLRGIQGNNMDQRSLPEDSLNSLIIKLIQADILKNKLSKQMVDVKENYQSTLPKAEAPREPERGGPAKSAFQPVIAMDTELLRQQRRYNSPRVLLSDSTPLEPPPLYLMEDYVGSPVVANRTSRRKRYAEHKSHRGEYSVCDSESLWVTDKSSAIDIRGHQVTVLGEIKTGNSPVKQYFYETRCKEARPVKNGCRGIDDKHWNSQCKTSQTYVRALTSENNKLVGWRWIRIDTSCVCALSRKIGRT

SEQ ID NO: 79 - DNA, 813 bp, Homo sapiens
  source 1..813: mol_type = genomic DNA
atggtcaccttcgccaccatcctgcaagtgaacaaagtgatgagcatcctgttctacgtgatcttcctggcctacctgagaggcatccagggcaacaacatggaccagagaagcctgcctgaggacagcctgaactccctgatcatcaagctgatccaggccgacatcctgaagaacaagctgagcaagcagatggtggacgtgaaagagaactaccagagcaccctgcctaaggccgaggctcctagagaacctgaaagaggcggacctgccaagagcgcctttcagcctgtgatcgccatggacaccgagctgctgagacagcagcggagatacaacagccccagagtgctgctgagcgacagcacacctcttgagcctccacctctgtacctgatggaagattacgtgggcagccccgtggtggccaacagaaccagcagaagaaagagatacgccgagcacaagagccaccggggcgagtactctgtgtgtgattctgagagcctgtgggtcaccgacaagagcagcgccatcgatatcagaggccaccaagtgacagtgctgggcgagatcaagaccggcaacagccctgtgaagcagtacttctacgagacacggtgcaaagaggccaggcctgtcaagaatggctgcagaggcatcgacgacaagcactggaacagccagtgcaagaccagccagacatatgtgcgggccctgaccagcgagaacaacaagctcgttggatggcggtggatcagaatcgacaccagctgtgtgtgcgccctgagcagaaagatcggcagaacataa

SEQ ID NO: 80 - DNA, 1020 bp, Homo sapiens
  source 1..1020: mol_type = genomic DNA
taacacagactcagctgccagagcctgctcttaacacctgtgtttccttttcagatcttacaggtgaacaaggtgatgtccatcttgttttatgtgatatttctcgcttatctccgtggcatccaaggtaacaacatggatcaaaggagtttgccagaagactcgctcaattccctcattattaagctgatccaggcagatattttgaaaaacaagctctccaagcagatggtggacgttaaggaaaattaccagagcaccctgcccaaagctgaggctccccgagagccggagcggggagggcccgccaagtcagcattccagccggtgattgcaatggacaccgaactgctgcgacaacagagacgctacaactcaccgcgggtcctgctgagcgacagcacccccttggagcccccgcccttgtatctcatggaggattacgtgggcagccccgtggtggcgaacagaacatcacggcggaaacggtacgcggagcataagagtcaccgaggggagtactcggtatgtgacagtgagagtctgtgggtgaccgacaagtcatcggccatcgacattcggggacaccaggtcacggtgctgggggagatcaaaacgggcaactctcccgtcaaacaatatttttatgaaacgcgatgtaaggaagccaggccggtcaaaaacggttgcaggggtattgatgataaacactggaactctcagtgcaaaacatcccaaacctacgtccgagcactgacttcagagaacaataaactcgtgggctggcggtggatacggatagacacgtcctgtgtgtgtgccttgtcgagaaaaatcggaagaacatgaattggcatctctccccatatataaattattactttaaattatatgatatgcatgtagcatataaatgtttatattgtttttatatattataagttgacctttatttattaaacttcagcaaccctacagtatataagcttttttctcaataaaatcagtgtgcttgccttc

SEQ ID NO: 81 - protein, 253 aa, Bos taurus
MSILFYVMFLAYLRGVQGNSMDQRSLPEDSLNSLIIKLIQADILKNKLSKQMVDVKENYQSTLPKAEAPPREPAKSEFQPVTAMGPELLRQQRRYSSPRVLLSDSTPLEPPPLYLMEDYVGSPVAANRTSRRKRYAEHKSHRGEYSVCDSESLWVTDKSSAIDIRGHQVTVLGEIKTGNSPVKQYFYETRCKEARPVKNGCRGIDDKHWNSQCKTSQTYVRALTSENNKLVGWRWIRIDTSCVCALSRKIGRT

SEQ ID NO: 82 - protein, 258 aa, Rattus norvegicus
MSILFYVIFLAYLRGIQGNNMDQRSLPEDSLNSLIIKLIQADILKNKLSKQMVDVKENYQSTLPKAEAPREPEQGEATRSEFQPMIATDTELLRQQRRYNSPRVLLSDSTPLEPPPLYLMEDYVGNPVVTNRTSPRRKRYAEHKSHRGEYSVCDSESLWVTDKSSAIDIRGHQVTVLGEIKTGNSPVKQYFYETRCKEARPVKNGCRGIDDKHWNSQCKTSQTYVRALTSENNKLVGWRWIRIDTSCVCALSRKIGRT

SEQ ID NO: 83 - protein, 257 aa, Sus scrofa
MSILFYMIFLAYLRGIQGNSMDQRRLPEDSLNSLIIKLIQADILKNKLSKQMVDLQENYQSTLPKAEAPREPERGEPAKSEFQPVTAVGPEWLRHHRRYNSPRVLLSDSTPLEPPPLYLVEDYVGNPSVANRTARRKRYAEHKSHRGEYSVCDSESLWVTDKSSAIDIRGHQVTVLGEIKTGNSPVKQYFYETRCKEARPVKNGCRGIDDKHWNSQCKTSQTYFRALTSYNNKLVGWRWIRIDTSCVCALSRKIGRT

SEQ ID NO: 84 - DNA, 4711 bp, synthetic construct
  source 1..4711: mol_type = other DNA
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgaccggtgccaccatggccttgctcatccacctcaagacagtctcggagctgcggggcaggggcgaccggatcgccaaagtgactttccgagggcaatccttctactctcgggtcctggagaactgtgaggatgtggctgactttgatgagacatttcggtggccggtggccagcagcatcgacagaaatgagatgctggagattcaggttttcaactacagcaaagtcttcagcaacaagctcatcgggaccttccgcatggtgctgcagaaggtggtagaggagagccatgtggaggtgactgacacgctgattgatgacaacaatgctatcatcaagaccagcctgtgcgtggaggtccggtatcaggccactgacggcacagtgggctcctgggacgatggggacttcctgggagatgagtctcttcaagaggaagagaaggacagccaagagacggatggactgctcccaggctcccggcccagctcccggcccccaggagagaagagcttccggagagccgggaggagcgtgttctccgccatgaagctcggcaaaaacaggtctcacaaggaggagccccaaagaccagatgaaccggcggtgctggagatggaagaccttgaccatctggccattcggctaggagatggactggatcccgactcggtgtctctagcctcagtcacagctctcaccactaatgtctccaacaagcgatctaagccagacattaagatggagccaagtgctgggcggcccatggattaccaggtcagcatcacggtgatcgaggcccggcagctggtgggcttgaacatggaccctgtggtgtgcgtggaggtgggtgacgacaagaagtacacatccatgaaggagtccactaactgcccctattacaacgagtacttcgtcttcgacttccatgtctctccggatgtcatgtttgacaagatcatcaagatttcggtgattcactccaagaacctgctgcgcagtggcaccctggtgggctccttcaaaatggacgtgggaaccgtgtactcgcagccagagcaccagttccatcacaagtgggccatcctgtctgaccccgatgacatctcctcggggctgaagggctacgtgaagtgtgacgttgccgtggtgggcaaaggggacaacatcaagacgccccacaaggccaatgagaccgacgaagatgacattgaggggaacttgctgctccccgagggggtgccccccgaacgccagtgggcccggttctatgtgaaaatttaccgagcagaggggctgccccgtatgaacacaagcctcatggccaatgtaaagaaggctttcatcggtgaaaacaaggacctcgtggacccctacgtgcaagtcttctttgctggccagaagggcaagacttcagtgcagaagagcagctatgagcccctgtggaatgagcaggtcgtctttacagacctcttccccccactctgcaaacgcatgaaggtgcagatccgagactcggacaaggtcaacgacgtggccatcggcacccacttcattgacctgcgcaagatttctaatgacggagacaaaggcttcctgcccacactgggcccagcctgggtgaacatgtacggctccacacgtaactacacgctgctggatgagcatcaggacctgaacgagggcctgggggagggtgtgtccttccgggcccggctcctgctgggcctggctgtggagatcgtagacacctccaaccctgagctcaccagctccacagaggtgcaggtggagcaggccacgcccatctcggagagctgtgcaggtaaaatggaagaattctttctctttggagccttcctggaggcctcaatgatcgaccggagaaacggagacaagcccatcacctttgaggtcaccataggcaactatgggaacgaagttgatggcctgtcccggccccagcggcctcggccccggaaggagccgggggatgaggaagaagtagacctgattcagaacgcaagtgatgacgaggccggtgatgccggggacctggcctcagtctcctccactccaccaatgcggccccaggtcaccgacaggaactacttccatctgccctacctggagcgaaagccctgcatctacatcaagagctggtggccggaccagcgccgccgcctctacaatgccaacatcatggaccacattgccgacaagctggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgaggtaagtatcaaggttacaagacaggtttaaggagaccaatagaaactgggcttgtcgagacagagaagactcttgcgtttctgggattttgccgatttcggcctattggttaaaaaatgagctgatttaacaaaaatttaacgcgaattttaacaaaataagcttgaattcagctgacgtgcctcggaccgctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 85 - DNA, 4664 bp, synthetic construct
  source 1..4664: mol_type = other DNA
cctgcaggcagctgcgcgctcgctcgctcactgaggccgcccgggcgtcgggcgacctttggtcgcccggcctcagtgagcgagcgagcgcgcagagagggagtggccaactccatcactaggggttcctgcggccgcacgcgtgggattttgccgatttcggcctattggttaaaaaatgagctgatttaacaaaaatttaacgcgaattttaacaaaatgataggcacctattggtcttactgacatccactttgcctttctctccacagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacggtcaggcttctccggcgctgccgtgtgctgtgcaatgggggctcctcctctcactccacaggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaactagtgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcaattcagactcccactagaagaaacagaacttgaaaaaaggataattgtggtgaacacctcaacccagtggtccaaaaactgaaaaactttgaccccgagcaccctcacacagatagactactgaaagaaggagaaaggggcacttactcagtctcccttatcagattgccttacgaggagtactagactccctcaagcaaatagatctcacttaccacttgcaaaggtatactactttcactctattagacctatatatctgaccagggtcctattccaagacaactcttctactcttccagcagactcttatagaaagaaagattctggggtccaagaaagcagtactttcttacaaggagccaaaaaaaataacctttctttagcacttctaaccttggagtgaactggtgatcaaagagaggttggctccctggggacaagtgccacaaattcagtcaactacaagaaagttgagaacactgttctcccgaaaccaagcttgaattcagctgacgtgcctcggaccgctaggaacccctagtgatggagttggccactccctctctgcgcgctcgctcgctcactgaggccgggcgaccaaaggtcgcccgacgcccgggctttgcccgggcggcctcagtgagcgagcgagcgcgcagctgcctgcagg

SEQ ID NO: 86 - DNA, 121 bp, synthetic construct
  source 1..121: mol_type = other DNA
caatgggagtttgttttggcaccaaaatcaacgggactttccaaaatgtcgtaacaactccgccccattgacgcaaatgggcggtaggcgtgtacggtgggaggtctatataagcagagct

SEQ ID NO: 87 - DNA, 4472 bp, synthetic construct
  source 1..4472: mol_type = other DNA
gggttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctaggatcacgcgttctagatcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcggccgggcccagcaccccaaggcggccaacgccaaaactctcccccctcctcttcctcaatctcgctctcgctctttttttttttcgcaaaaggaggggagagggggtaaaaaaatgctgcactgtgcggcgaagccggtgagtgagcggcgcggggccaatcagcgtgcgccgttccgaaagttgccttttatggctcgagcggccggccgcggcggcgccctataaaacccagcggcgcgacgcgccaccaccgccgagaccgcgtccgccccgcgagcacagagcctcgcctttgccgatccgccgcccgtccacacccgccgccaggtaagcccggccagccgaccggggcaggcggctcacggcccggccgcaggcggccgcgccaccatggtgagcaagggcgaggagctgttcaccggggtggtgcccatcctggtcgagctggacggcgacgtaaacggccacaagttcagcgtgtccggcgagggcgagggcgatgccacctacggcaagctgaccctgaagttcatctgcaccaccggcaagctgcccgtgccctggcccaccctcgtgaccaccctgacctacggcgtgcagtgcttcagccgctaccccgaccacatgaagcagcacgacttcttcaagtccgccatgcccgaaggctacgtccaggagcgcaccatcttcttcaaggacgacggcaactacaagacccgcgccgaggtgaagttcgagggcgacaccctggtgaaccgcatcgagctgaagggcatcgacttcaaggaggacggcaacatcctggggcacaagctggagtacaactacaacagccacaacgtctatatcatggccgacaagcagaagaacggcatcaaggtgaacttcaagatccgccacaacatcgaggacggcagcgtgcagctcgccgaccactaccagcagaacacccccatcggcgacggccccgtgctgctgcccgacaaccactacctgagcacccagtccgccctgagcaaagaccccaacgagaagcgcgatcacatggtcctgctggagttcgtgaccgccgccgggatcactctcggcatggacgagctgtacaagaagcttggaagcggagctactaacttcagcctgctgaagcaggctggagacgtggaggagaaccctggacctgaattcgccaccatggccctgattgttcacctcaagactgtctcagagctccgaggcaaaggtgaccggattgccaaagtcactttccgagggcagtctttctactcccgggtcctggagaactgcgagggtgtggctgactttgatgagacgttccggtggccagtggccagcagcatcgaccggaatgaagtgttggagattcagattttcaactacagcaaagtcttcagcaacaagctgatagggaccttctgcatggtgctgcagaaagtggtggaggagaatcgggtagaggtgaccgacacgctgatggatgacagcaatgctatcatcaagaccagcctgagcatggaggtccggtatcaggccacagatggcactgtgggcccctgggatgatggagacttcctgggagatgaatccctccaggaggagaaggacagccaggagacagatgggctgctacctggttcccgacccagcacccggatatctggcgagaagagctttcgcagagcgggaaggagtgtgttctcggccatgaaactcggcaaaactcggtcccacaaagaggagccccaaagacaagatgagccagcagtgctggagatggaggacctggaccacctagccattcagctgggggatgggctggaccctgactccgtgtctctagcctcggtcaccgctctcaccagcaatgtctccaacaaacggtctaagccagatattaagatggagcccagtgctggaaggcccatggattaccaggtcagcatcacagtgattgaggctcggcagctggtgggcttgaacatggaccctgtggtgtgtgtggaggtgggtgatgacaagaaatacacgtcaatgaaggagtccacaaactgcccttactacaacgagtactttgtcttcgacttccatgtctctcctgatgtcatgtttgacaagatcatcaagatctcggttatccattctaagaacctgcttcggagcggcaccctggtgggttccttcaaaatggatgtggggactgtgtattcccagcctgaacaccagttccatcacaaatgggccatcctgtcagaccccgatgacatctctgctgggttgaagggttatgtaaagtgtgatgtcgctgtggtgggcaagggagacaacatcaagacaccccacaaggccaacgagacggatgaggacgacattgaagggaacttgctgctccccgagggcgtgccccccgaacggcagtgggcacggttctatgtgaaaatttaccgagcagagggactgccccggatgaacacaagcctcatggccaacgtgaagaaggcgttcatcggtgagaacaaggacctcgtcgacccctatgtgcaagtcttctttgctggacaaaagggcaaaacatcagtgcagaagagcagctatgagccgctatggaatgagcaggtcgtcttcacagacttgttccccccactctgcaaacgcatgaaggtgcagatccgggactctgacaaggtcaatgatgtggccatcggcacccacttcatcgacctgcgcaagatttccaacgatggagacaaaggcttcctgcctaccctcggtccagcctgggtgaacatgtacggctccacgcgcaactacacactgctggacgagcaccaggacttgaatgaaggcctgggggagggtgtgtccttccgggcccgcctcatgttgggactagctgtggagatcctggacacctccaacccagagctcaccagctccacggaggtgcaggtggagcaggccacgcctgtctcggagagctgcacagggagaatggaagaattttttctatttggagccttcttggaagcctcaatgattgaccggaaaaatggggacaagccaattacctttgaggtgaccataggaaactacggcaatgaagtcgatggtatgtcccggcccctgaggcctcggccccggaaagagcctggggatgaagaagaggtagacctgattcagaactccagtgacgatgaaggtgacgaagccggggacctggcctcggtgtcctccaccccacctatgcggccccagatcacggacaggaactatttccacctgccctacctggagcgcaagccctgcatctatatcaagagctggtggcctgaccagaggcggcgcctctacaatgccaacatcatggatcacattgctgacaagctggaagaaggcctgaatgatgtacaggagatgatcaaaacggagaagtcctacccggagcgccgcctgcggggtgtgctagaggaactcagctgtggctgccaccgcttcctctccctctcggacaaggaccagggccgctcgtcccgcaccaggctggatcgagagcgtcttaagtcctgtatgagggagttggagagcatgggacagcaggccaagagcctgagggctcaggtgaagcggcacactgttcgggacaagctgaggtcatgccagaactttctgcagaagctacgcttcctggcggatgaggtaagtatcaaggttacaagacaggtttaaggagaccaatagaaactgggcttgtcgagacagagaagactcttgcgtttctggcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 88 - DNA, 4674 bp, synthetic construct
  source 1..4674: mol_type = other DNA
gggttggccactccctctctgcgcgctcgctcgctcactgaggccgggcgaccaaaggtcgcccgacgcccgggctttgcccgggcggcctcagtgagcgagcgagcgcgcagagagggagtggccaactccatcactaggggttcctagatctaggatcacgcgtgataggcacctattggtcttactgacatccactttgcctttctctccacagccccagcacagcattccggatgtgttcatttggatgatgagcaacaacaaacgtatcgcctatgcccgcgtgccttccaaagacctgctcttctccatcgtggaggaggaactgggcaaggactgcgccaaagtcaagaccctcttcctgaagctgccagggaagaggggcttcggctcggcaggctggacagtacaggccaagctggagctctacctgtggctgggcctcagcaagcagcgaaaggacttcctgtgtggtctgccctgtggcttcgaggaggtcaaggcagcccaaggcctgggcctgcattcctttccgcccatcagcctagtctacaccaagaagcaagccttccagctccgagcacacatgtatcaggcccgaagcctctttgctgctgacagcagtgggctctctgatccctttgcccgtgtcttcttcatcaaccagagccaatgcactgaggttctaaacgagacactgtgtcccacctgggaccagatgctggtatttgacaacctggagctgtacggtgaagctcacgagttacgagatgatccccccatcattgtcattgaaatctacgaccaggacagcatgggcaaagccgacttcatgggccggaccttcgccaagcccctggtgaagatggcagatgaagcatactgcccacctcgcttcccgccgcagcttgagtactaccagatctaccgaggcagtgccactgccggagacctactggctgccttcgagctgctgcagattgggccatcagggaaggctgacctgccacccatcaatggcccagtggacatggacagagggcccatcatgcctgtgcccgtgggaatccggccagtgctcagcaagtaccgagtggaggtgctgttctggggcctgagggacctaaagagggtgaacctggcccaggtggaccgaccacgggtggacatcgagtgtgcaggaaagggggtacaatcctccctgattcacaattataagaagaaccccaacttcaacacgctggtcaagtggtttgaagtggacctcccggagaatgagctcctgcacccacccttgaacatccgagtggtagattgccgggcctttggacgatacaccctggtgggttcccacgcagtcagctcactgaggcgcttcatctaccgacctccagaccgctcagcccccaactggaacaccacaggggaggttgtagtaagcatggagcctgaggagccagttaagaagctggagaccatggtgaaactggatgcgacttctgatgctgtggtcaaggtggatgtggctgaagatgagaaggaaaggaagaagaagaaaaagaaaggcccgtcagaggagccagaggaggaagagcccgatgagagcatgctggattggtggtccaagtacttcgcctccatcgacacaatgaaggagcaacttcgacaacatgagacctctggaactgacttggaagagaaggaagagatggaaagcgctgagggcctgaagggaccaatgaagagcaaggagaagtccagagctgcaaaggaggagaaaaagaagaaaaaccagagccctggccctggccagggatcggaggctcctgagaagaagaaagccaagatcgatgagcttaaggtgtaccccaaggagctggaatcggagtttgacagctttgaggactggctgcacaccttcaacctgttgaggggcaagacgggagatgatgaggatggctccacagaggaggagcgcatagtaggccgattcaagggctccctctgtgtgtacaaagtgccactcccagaagatgtatctcgagaagctggctatgatcccacctatggaatgttccagggcatcccaagcaatgaccccatcaatgtgctggtccgaatctatgtggtccgggccacagacctgcacccggccgacatcaatggcaaagctgacccctatattgccatcaagttaggcaagaccgacatccgagacaaggagaactacatctccaagcagctcaaccctgtgtttgggaagtcctttgacattgaggcctccttccccatggagtccatgttgacagtggccgtgtacgactgggatctggtgggcactgatgacctcatcggagaaaccaagattgacctggaaaaccgcttctacagcaagcatcgcgccacctgcggcatcgcacagacctattccatacatggctacaatatctggagggaccccatgaagcccagccagatcctgacacgcctctgtaaagagggcaaagtggacggcccccactttggtccccatgggagagtgagggttgccaaccgtgtcttcacggggccttcagaaatagaggatgagaatggtcagaggaagcccacagatgagcacgtggcactgtctgctctgagacactgggaggacatcccccgggtgggctgccgccttgtgccggaacacgtggagaccaggccgctgctcaaccctgacaagccaggcattgagcagggccgcctggagctgtgggtggacatgttccccatggacatgccagcccctgggacacctctggatatatcccccaggaaacccaagaagtacgagctgcgggtcatcgtgtggaacacagacgaggtggtcctggaagacgatgatttcttcacgggagagaagtccagtgacatttttgtgagggggtggctgaagggccagcaggaggacaaacaggacacagatgtccactatcactccctcacgggggagggcaacttcaactggagatacctcttccccttcgactacctagcggccgaagagaagatcgttatgtccaaaaaggagtctatgttctcctgggatgagacggagtacaagatccctgcgcggctcaccctgcagatctgggacgctgaccacttctcggctgacgacttcctgggggctatcgagctggacctgaaccggttcccgaggggcgctaagacagccaagcagtgcaccatggagatggccaccggggaggtggacgtacccctggtttccatctttaaacagaaacgtgtcaaaggctggtggcccctcctggcccgcaatgagaatgatgagtttgagctcacaggcaaagtggaggcggagctacacctactcacggcagaggaggcagagaagaaccctgtgggcctggctcgcaatgaacctgatcccctagaaaaacccaaccggcctgacacggcattcgtctggttcctgaacccactcaaatctatcaagtacctcatctgcacccggtacaagtggctgatcatcaagatcgtgctggcgctgctggggctgctcatgctggccctcttcctttacagcctcccaggctacatggtcaagaagctcctaggggcctgaggtaccgcgggcccgggatccactagttctagagcggccgcaagcttatcgataatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctgatcgataccgtcgactagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggagagatctaggaacccctagtgatggagttggccactccctctctgcgcgctcgctcgctcactgaggccgcccgggcaaagcccgggcgtcgggcgacctttggtcgcccggcctcagtgagcgagcgagcgcgcagagagggagtggccaa

SEQ ID NO: 89 - DNA, 872 bp, synthetic construct
  source 1..872: mol_type = other DNA
ctaggtggaggccgaaagtacatgtttcgcatgggaaccccagaccctgagtacccagatgactacagccaaggtgggaccaggctggacgggaagaatctggtgcaggaatggctggcgaagcgccagggtgcccggtatgtgtggaaccgcactgagctcatgcaggcttccctggacccgtctgtgacccatctcatgggtctctttgagcctggagacatgaaatacgagatccaccgagactccacactggacccctccctgatggagatgacagaggctgccctgcgcctgctgagcaggaacccccgcggcttcttcctcttcgtggagggtggtcgcatcgaccatggtcatcatgaaagcagggcttaccgggcactgactgagacgatcatgttcgacgacgccattgagagggcgggccagctcaccagcgaggaggacacgctgagcctcgtcactgccgaccactcccacgtcttctccttcggaggctaccccctgcgagggagctccatcttcgggctggcccctggcaaggcccgggacaggaaggcctacacggtcctcctatacggaaacggtccaggctatgtgctcaaggacggcgcccggccggatgttaccgagagcgagagcgggagccccgagtatcggcagcagtcagcagtgcccctggacgaagagacccacgcaggcgaggacgtggcggtgttcgcgcgcggcccgcaggcgcacctggttcacggcgtgcaggagcagaccttcatagcgcacgtcatggccttcgccgcctgcctggagccctacaccgcctgcgacctggcgccccccgccggcaccaccgacgccgcgcacccggggcg

SEQ ID NO: 90 - DNA, 497 bp, Homo sapiens
  source 1..497: mol_type = genomic DNA
agacttgcccaaaaactctggcaaagttgaattgcttccaaaagttcaactttatcagaaggacctattccctacggaaactagctgaaggtctcctggcactctggatctcgtggaagggagccttcttcagggaacagagggagcgattaagtggtgaaaagcaaacagacctggaaaagttccctttctgagagtagcaacagaaagctctgcaaagactccctccaagctattggatcctcttgcttgggataaccacttgagtactcagataccaaaagaagagtggaaatcccaagagaagtcaccagaaaaaacagcttttaagaaaaaggatacacttttgtccctgaacgcttgtgaaagcaatctgacaatagcagcaattgaaaagggacaaaataagcccgaaatagaagtcacctgggcaaagcaaggtaggactgaaaggctgtgctctcaaaacccaccagtcttgaaacgcactcaacggg

SEQ ID NO: 91 - DNA, 499 bp, Homo sapiens
  source 1..499: mol_type = genomic DNA
gtagtaggaaagggtgaatttacaaaggacgtaggactcaaagagtgagtttttccaagcagcagaaacctatttcttactaacttggataatttactgaaaaataatacacacaatcaagaaaaaaaaattcaggaagaaatagaaaagaaggaaaacttaatccaagagtgaatagttttgcctcagataactacagtgactggcactaagaatttctgaaagaaccttttcttactgagcactaggctgaaaatagaaggttacttgaacggggacttgactccagtacttcaagattttaggtactttgaaaattcaacaaatagaacaaagaaacacacagctactttctcaaaaaaaggggaggaagaaaacttggaaggcttgggaaatcaaaccaagcaaattgtagagaaattgactgacaccacaaggatatctcctaatacaagccagcagaattttgtcacgcaacgtagtaagagagctttgaaac

SEQ ID NO: 92 - DNA, 2523 bp, synthetic construct
  source 1..2523: mol_type = other DNA
atggccctgctgatccacctgaaaaccgtgtccgagctgagaggcagaggcgacagaatcgccaaagtgaccttccggggccagagcttctacagcagagtgctggaaaactgcgaggacgtggccgacttcgacgagacattcagatggcctgtggccagcagcatcgaccggaacgagatgctggaaatccaggtgttcaactacagcaaggtgttcagcaacaagctgatcggcaccttcagaatggtgctgcagaaagtggtggaagagtcccacgtggaagtgaccgacacactgatcgacgacaacaacgccatcatcaagaccagcctgtgtgtggaagtgcgctaccaggccacagatggcacagtcggctcttgggacgatggcgatttcctgggcgacgagagcctgcaagaggaagagaaggacagccaagagacagacggcctgctgcctggctctagaccttcttctagacctcctggcgagaagtcctttcggagagccggcagatctgtgttcagcgccatgaagctgggcaagaacagaagccacaaagaggaaccccagcggcctgatgaacctgccgttctggaaatggaagatctggaccacctggccatcagactcggcgacggacttgatcctgatagcgtgtcactggccagcgtgacagccctgaccaccaacgtgtccaacaagagaagcaagcccgacatcaagatggaacccagcgccggcagacccatggattaccaggtgtccatcaccgtgatcgaggccagacagctcgtgggcctgaacatggatcctgtcgtgtgcgtggaagtcggcgacgacaaaaagtacaccagcatgaaggaaagcacgaactgcccctactacaacgagtacttcgtgttcgactttcacgtgtccccagacgtgatgttcgacaagatcattaagatcagcgtgatccacagcaagaacctgctgagaagcggcacactcgtgggcagctttaagatggatgtgggcaccgtgtacagccagcctgagcaccagtttcaccacaagtgggccatcctgagcgaccccgatgatatcagctctggactgaagggctacgtgaagtgtgatgtggccgtcgtcggcaagggcgacaacatcaagacaccccacaaggccaacgaaaccgacgaggacgacatcgagggcaacctgttgctgcctgaaggcgtgccaccagaaagacagtgggcccgcttttacgtgaagatctacagagccgagggcctgcctcggatgaacacaagcctgatggctaacgtgaagaaggcctttatcggcgagaacaaggacctggtggacccctacgtgcaggttttctttgccggccagaaaggcaagacctccgtgcagaagtctagctacgagcccctgtggaacgaacaggtggtgttcaccgatctgttccctccactgtgcaagcggatgaaggtgcagattcgggacagcgacaaagtgaacgacgtggccatcggcacccacttcatcgacctgcggaagatcagcaacgacggcgacaagggcttcctgcctacacttggacctgcctgggtcaacatgtacggcagcaccagaaactacaccctgttggacgagcaccaggacctgaatgaaggactcggagagggcgtgtccttcagagccagactgctgctgggactcgccgtggaaatcgtggacaccagcaatcccgagctgaccagctctacagaggtgcaggttgagcaggccacacctatcagcgagtcttgcgccggaaagatggaagagttcttcctgttcggcgccttcctggaagccagcatgatcgacagacggaacggcgataagcccatcaccttcgaagtgaccatcggcaactacggcaacgaggtggacggcctgagcagacctcaaagaccccggcctagaaaagagcccggcgacgaggaagaggtggacctgattcagaacgccagcgacgatgaagcaggcgacgctggcgatctggcaagcgttagtagcacccctcctatgaggccccaagtgacagaccggaactactttcatctgccctacctggaacggaagccctgcatctacatcaagagctggtggcccgaccagcggcggagactgtacaacgccaatatcatggaccacattgccgacaagctggaagagggcctgaatgacatccaagagatgatcaagaccgagaagtcttaccccgagcggaggctgaggggagtcctggaagaactgagctgcggctgctgcagatttctgagcctggccgataaggaccagggccacagcagcagaaccagactggacagagagcggctgaagtcctgcatgagagaactggaaaacatgggccagcaggcccggatgctgagagcccaagtgaagagacacaccgtgcgggacaagctgaggctgtgccagaacttcctgcagaagctgagattcctggctgacgag

SEQ ID NO: 93 - DNA, 3471 bp, synthetic construct
  source 1..3471: mol_type = other DNA
ccccagcacagcatccccgatatcttcatctggatgatgagcaacaacaagcgcgtggcctacgccagagtgccctctaaggatctgctgttcagcatcgtggaagaggaaaccggcaaggactgcgccaaagtgaaaaccctgttcctgaagctgcccggcaagagaggctttggatctgccggatggacagtgcaggccaaggtggaactgtatctgtggctgggcctgagcaagcagcggaaagaattcctgtgtggcctgccttgcggcttccaagaagtgaaggctgcccaaggactgggcctgcatgcctttccacctgtgtctctggtgtacacaaagaagcaggccttccagctgcgggcccacatgtatcaggccagatctctgtttgccgccgacagctctggcctgtccgatccttttgccagagtgttcttcatcaaccagagccagtgcaccgaggtgctgaacgagacactgtgccctacctgggaccagatgctggtgttcgacaacctcgagctgtatggcgaggcccacgagctgagagatgaccctcctatcatcgtgatcgagatctacgaccaggacagcatgggcaaagccgacttcatgggcagaaccttcgccaagcctctggtcaagatggccgacgaggcctactgtcctcctagattccctccacagctggaatattaccagatctaccggggcaacgccacagccggcgatctgcttgctgcttttgagctgctgcagatcggccctgccggaaaggctgatctgcctccaatcaacggccccgtggatgtggatagaggccccattatgcctgtgcctatgggcatcagacccgtgctgagcaagtacagagtggaagtgctgttctggggcctgcgcgacctgaagagagtgaatctggctcaggtggacagacccagagtggacattgagtgtgccggcaagggcgtgcagtctagcctgatccacaactacaagaagaaccccaacttcaacaccctggtcaagtggttcgaggtggacctgcctgagaacgaactgctgcaccctccactgaacatcagagtggtggactgcagagccttcggcagatacacactcgtgggctctcatgccgtgtccagcctgcggagattcatctacagacctccagacagaagcgcccctagctggaacaccacagtccggctgctgagaagatgccgggtgctgtgtaatggcggcagcagcagtcatagcacaggcgaggtggtggtcaccatggaacctgaggtgcccatcaagaaactggaaaccatggtcaagctggacgccacctctgaggccgtggtcaaagtggacgtggccgaggaagagaaagagaagaaaaagaaaaaaaagggcaccgccgaggaacccgaagaggaagaacctgacgagagcatgctggactggtggtccaagtacttcgccagcatcgacaccatgaaggaacagctgagacagcaagagcccagcggcatcgacctcgaagagaaagaagaggtggacaacaccgagggcctgaagggcagcatgaagggcaaagagaaagccagagccgccaaagaggaaaagaagaagaaaacccagagcagcggcagcggccagggatctgaagcccctgaaaaaaagaagcccaagatcgacgagctgaaggtgtaccccaaagagctggaaagcgagttcgacaatttcgaggactggctgcacaccttcaacctgctgagaggcaagaccggcgacgatgaggatggcagcactgaagaggaacggatcgtgggcagattcaagggcagcctgtgcgtgtacaaggtgccactgcctgaggacgtgtccagagaggccggatacgatagcacctacggcatgttccagggcatccccagcaacgaccccatcaatgtgcttgtgcgggtgtacgttgtgcgggccacagatctgcaccccgccgatatcaatggcaaggccgatccttatatcgccatccggctgggcaagacagacatccgggacaaagagaactacatctccaagcagctgaaccccgtgttcggcaagagcttcgacatcgaggccagctttcccatggaatccatgctgaccgtggccgtgtacgactgggatctcgtgggcaccgatgatctgatcggcgagacaaagatcgacctggaaaaccggttctacagcaagcaccgggccacctgtggaatcgcccagacatatagcacacacggctacaacatctggcgggaccccatgaagcccagccagatcttgacacggctgtgcaaggatggcaaggtggacggccctcattttggcccacctggcagagtgaaggtggccaacagagtgtttacaggcccctccgagatcgaggacgagaacggccagagaaaacctaccgatgagcacgtggcactgctggccctgagacactgggaagatatccctagagccggctgcagactggtgcccgaacacgtggaaacaagacccctgctgaaccctgacaagcccggcattgaacagggcagactggaactgtgggtcgacatgttccccatggacatgcctgcacctggcacacccctggacatcagccctagaaagcctaagaaatacgagctgcgcgtgatcatctggaataccgacgaagtggtgctggaagatgacgacttcttcaccggcgagaagtccagcgacatcttcgtcagaggatggctgaaaggccagcaagaggacaagcaggacaccgacgtgcactaccatagcctgaccggcgagggcaacttcaattggcggtatctgttccccttcgactacctggccgccgaagagaagatcgtgatcagcaagaaagaatccatgttcagctgggacgagacagagtacaagatccccgccagactgaccctgcagatttgggacgccgatcacttcagcgccgacgattttctgggagccatcgagctggatctgaacagattccccagaggcgccaagaccgccaagcagtgtacaatggaaatggccaccggcgaagtggatgtgcccctggtgtccatcttcaagcagaaacgagtgaaaggctggtggcccctgctggccagaaatgagaacgacgagtttgagctgaccggaaaggtggaagccgagctgcatctgctgacagccgaagaggccgagaagaatcctgtgggactcgcccggaacgagcccgatcctctggaaaagcccaacagacccgataccgccttcgtgtggttcctgaatcctctgaagtccatcaagtacctgatctgtacccggtacaagtggctgatcatcaagatcgtgctggctctgctgggactgctgatgctcggcctgtttctgtacagcctgcctggctatatggtcaagaagctgctgggagcctaa

SEQ ID NO: 94 - DNA, 2520 bp, synthetic construct
  source 1..2520: mol_type = other DNA
atggccctgattgttcacctcaagactgtctcagagctccgaggcaaaggtgaccggattgccaaagtcactttccgagggcagtctttctactcccgggtcctggagaactgcgagggtgtggctgactttgatgagacgttccggtggccagtggccagcagcatcgaccggaatgaagtgttggagattcagattttcaactacagcaaagtcttcagcaacaagctgatagggaccttctgcatggtgctgcagaaagtggtggaggagaatcgggtagaggtgaccgacacgctgatggatgacagcaatgctatcatcaagaccagcctgagcatggaggtccggtatcaggccacagatggcactgtgggcccctgggatgatggagacttcctgggagatgaatccctccaggaggagaaggacagccaggagacagatgggctgctacctggttcccgacccagcacccggatatctggcgagaagagctttcgcagagcgggaaggagtgtgttctcggccatgaaactcggcaaaactcggtcccacaaagaggagccccaaagacaagatgagccagcagtgctggagatggaggacctggaccacctagccattcagctgggggatgggctggaccctgactccgtgtctctagcctcggtcaccgctctcaccagcaatgtctccaacaaacggtctaagccagatattaagatggagcccagtgctggaaggcccatggattaccaggtcagcatcacagtgattgaggctcggcagctggtgggcttgaacatggaccctgtggtgtgtgtggaggtgggtgatgacaagaaatacacgtcaatgaaggagtccacaaactgcccttactacaacgagtactttgtcttcgacttccatgtctctcctgatgtcatgtttgacaagatcatcaagatctcggttatccattctaagaacctgcttcggagcggcaccctggtgggttccttcaaaatggatgtggggactgtgtattcccagcctgaacaccagttccatcacaaatgggccatcctgtcagaccccgatgacatctctgctgggttgaagggttatgtaaagtgtgatgtcgctgtggtgggcaagggagacaacatcaagacaccccacaaggccaacgagacggatgaggacgacattgaagggaacttgctgctccccgagggcgtgccccccgaacggcagtgggcacggttctatgtgaaaatttaccgagcagagggactgccccggatgaacacaagcctcatggccaacgtgaagaaggcgttcatcggtgagaacaaggacctcgtcgacccctatgtgcaagtcttctttgctggacaaaagggcaaaacatcagtgcagaagagcagctatgagccgctatggaatgagcaggtcgtcttcacagacttgttccccccactctgcaaacgcatgaaggtgcagatccgggactctgacaaggtcaatgatgtggccatcggcacccacttcatcgacctgcgcaagatttccaacgatggagacaaaggcttcctgcctaccctcggtccagcctgggtgaacatgtacggctccacgcgcaactacacactgctggacgagcaccaggacttgaatgaaggcctgggggagggtgtgtccttccgggcccgcctcatgttgggactagctgtggagatcctggacacctccaacccagagctcaccagctccacggaggtgcaggtggagcaggccacgcctgtctcggagagctgcacagggagaatggaagaattttttctatttggagccttcttggaagcctcaatgattgaccggaaaaatggggacaagccaattacctttgaggtgaccataggaaactacggcaatgaagtcgatggtatgtcccggcccctgaggcctcggccccggaaagagcctggggatgaagaagaggtagacctgattcagaactccagtgacgatgaaggtgacgaagccggggacctggcctcggtgtcctccaccccacctatgcggccccagatcacggacaggaactatttccacctgccctacctggagcgcaagccctgcatctatatcaagagctggtggcctgaccagaggcggcgcctctacaatgccaacatcatggatcacattgctgacaagctggaagaaggcctgaatgatgtacaggagatgatcaaaacggagaagtcctacccggagcgccgcctgcggggtgtgctagaggaactcagctgtggctgccaccgcttcctctccctctcggacaaggaccagggccgctcgtcccgcaccaggctggatcgagagcgtcttaagtcctgtatgagggagttggagagcatgggacagcaggccaagagcctgagggctcaggtgaagcggcacactgttcgggacaagctgaggtcatgccagaactttctgcagaagctacgcttcctggcggatgag

SEQ ID NO: 95 - DNA, 3414 bp, synthetic construct
  source 1..3414: mol_type = other DNA
ccccagcacagcattccggatgtgttcatttggatgatgagcaacaacaaacgtatcgcctatgcccgcgtgccttccaaagacctgctcttctccatcgtggaggaggaactgggcaaggactgcgccaaagtcaagaccctcttcctgaagctgccagggaagaggggcttcggctcggcaggctggacagtacaggccaagctggagctctacctgtggctgggcctcagcaagcagcgaaaggacttcctgtgtggtctgccctgtggcttcgaggaggtcaaggcagcccaaggcctgggcctgcattcctttccgcccatcagcctagtctacaccaagaagcaagccttccagctccgagcacacatgtatcaggcccgaagcctctttgctgctgacagcagtgggctctctgatccctttgcccgtgtcttcttcatcaaccagagccaatgcactgaggttctaaacgagacactgtgtcccacctgggaccagatgctggtatttgacaacctggagctgtacggtgaagctcacgagttacgagatgatccccccatcattgtcattgaaatctacgaccaggacagcatgggcaaagccgacttcatgggccggaccttcgccaagcccctggtgaagatggcagatgaagcatactgcccacctcgcttcccgccgcagcttgagtactaccagatctaccgaggcagtgccactgccggagacctactggctgccttcgagctgctgcagattgggccatcagggaaggctgacctgccacccatcaatggcccagtggacatggacagagggcccatcatgcctgtgcccgtgggaatccggccagtgctcagcaagtaccgagtggaggtgctgttctggggcctgagggacctaaagagggtgaacctggcccaggtggaccgaccacgggtggacatcgagtgtgcaggaaagggggtacaatcctccctgattcacaattataagaagaaccccaacttcaacacgctggtcaagtggtttgaagtggacctcccggagaatgagctcctgcacccacccttgaacatccgagtggtagattgccgggcctttggacgatacaccctggtgggttcccacgcagtcagctcactgaggcgcttcatctaccgacctccagaccgctcagcccccaactggaacaccacaggggaggttgtagtaagcatggagcctgaggagccagttaagaagctggagaccatggtgaaactggatgcgacttctgatgctgtggtcaaggtggatgtggctgaagatgagaaggaaaggaagaagaagaaaaagaaaggcccgtcagaggagccagaggaggaagagcccgatgagagcatgctggattggtggtccaagtacttcgcctccatcgacacaatgaaggagcaacttcgacaacatgagacctctggaactgacttggaagagaaggaagagatggaaagcgctgagggcctgaagggaccaatgaagagcaaggagaagtccagagctgcaaaggaggagaaaaagaagaaaaaccagagccctggccctggccagggatcggaggctcctgagaagaagaaagccaagatcgatgagcttaaggtgtaccccaaggagctggaatcggagtttgacagctttgaggactggctgcacaccttcaacctgttgaggggcaagacgggagatgatgaggatggctccacagaggaggagcgcatagtaggccgattcaagggctccctctgtgtgtacaaagtgccactcccagaagatgtatctcgagaagctggctatgatcccacctatggaatgttccagggcatcccaagcaatgaccccatcaatgtgctggtccgaatctatgtggtccgggccacagacctgcacccggccgacatcaatggcaaagctgacccctatattgccatcaagttaggcaagaccgacatccgagacaaggagaactacatctccaagcagctcaaccctgtgtttgggaagtcctttgacattgaggcctccttccccatggagtccatgttgacagtggccgtgtacgactgggatctggtgggcactgatgacctcatcggagaaaccaagattgacctggaaaaccgcttctacagcaagcatcgcgccacctgcggcatcgcacagacctattccatacatggctacaatatctggagggaccccatgaagcccagccagatcctgacacgcctctgtaaagagggcaaagtggacggcccccactttggtccccatgggagagtgagggttgccaaccgtgtcttcacggggccttcagaaatagaggatgagaatggtcagaggaagcccacagatgagcacgtggcactgtctgctctgagacactgggaggacatcccccgggtgggctgccgccttgtgccggaacacgtggagaccaggccgctgctcaaccctgacaagccaggcattgagcagggccgcctggagctgtgggtggacatgttccccatggacatgccagcccctgggacacctctggatatatcccccaggaaacccaagaagtacgagctgcgggtcatcgtgtggaacacagacgaggtggtcctggaagacgatgatttcttcacgggagagaagtccagtgacatttttgtgagggggtggctgaagggccagcaggaggacaaacaggacacagatgtccactatcactccctcacgggggagggcaacttcaactggagatacctcttccccttcgactacctagcggccgaagagaagatcgttatgtccaaaaaggagtctatgttctcctgggatgagacggagtacaagatccctgcgcggctcaccctgcagatctgggacgctgaccacttctcggctgacgacttcctgggggctatcgagctggacctgaaccggttcccgaggggcgctaagacagccaagcagtgcaccatggagatggccaccggggaggtggacgtacccctggtttccatctttaaacagaaacgtgtcaaaggctggtggcccctcctggcccgcaatgagaatgatgagtttgagctcacaggcaaagtggaggcggagctacacctactcacggcagaggaggcagagaagaaccctgtgggcctggctcgcaatgaacctgatcccctagaaaaacccaaccggcctgacacggcattcgtctggttcctgaacccactcaaatctatcaagtacctcatctgcacccggtacaagtggctgatcatcaagatcgtgctggcgctgctggggctgctcatgctggccctcttcctttacagcctcccaggctacatggtcaagaagctcctaggggcctga

SEQ ID NO: 96 - DNA, 4744 bp, synthetic construct
  source 1..4744: mol_type = other DNA
ttggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttcctttgtcgacgcggccgcacgcgtgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgggtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcgggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacagctcctgggcaacgtgctggttattgtgaccggtgccaccatggccttgctcatccacctcaagacagtctcggagctgcggggcaggggcgaccggatcgccaaagtgactttccgagggcaatccttctactctcgggtcctggagaactgtgaggatgtggctgactttgatgagacatttcggtggccggtggccagcagcatcgacagaaatgagatgctggagattcaggttttcaactacagcaaagtcttcagcaacaagctcatcgggaccttccgcatggtgctgcagaaggtggtagaggagagccatgtggaggtgactgacacgctgattgatgacaacaatgctatcatcaagaccagcctgtgcgtggaggtccggtatcaggccactgacggcacagtgggctcctgggacgatggggacttcctgggagatgagtctcttcaagaggaagagaaggacagccaagagacggatggactgctcccaggctcccggcccagctcccggcccccaggagagaagagcttccggagagccgggaggagcgtgttctccgccatgaagctcggcaaaaacaggtctcacaaggaggagccccaaagaccagatgaaccggcggtgctggagatggaagaccttgaccatctggccattcggctaggagatggactggatcccgactcggtgtctctagcctcagtcacagctctcaccactaatgtctccaacaagcgatctaagccagacattaagatggagccaagtgctgggcggcccatggattaccaggtcagcatcacggtgatcgaggcccggcagctggtgggcttgaacatggaccctgtggtgtgcgtggaggtgggtgacgacaagaagtacacatccatgaaggagtccactaactgcccctattacaacgagtacttcgtcttcgacttccatgtctctccggatgtcatgtttgacaagatcatcaagatttcggtgattcactccaagaacctgctgcgcagtggcaccctggtgggctccttcaaaatggacgtgggaaccgtgtactcgcagccagagcaccagttccatcacaagtgggccatcctgtctgaccccgatgacatctcctcggggctgaagggctacgtgaagtgtgacgttgccgtggtgggcaaaggggacaacatcaagacgccccacaaggccaatgagaccgacgaagatgacattgaggggaacttgctgctccccgagggggtgccccccgaacgccagtgggcccggttctatgtgaaaatttaccgagcagaggggctgccccgtatgaacacaagcctcatggccaatgtaaagaaggctttcatcggtgaaaacaaggacctcgtggacccctacgtgcaagtcttctttgctggccagaagggcaagacttcagtgcagaagagcagctatgagcccctgtggaatgagcaggtcgtctttacagacctcttccccccactctgcaaacgcatgaaggtgcagatccgagactcggacaaggtcaacgacgtggccatcggcacccacttcattgacctgcgcaagatttctaatgacggagacaaaggcttcctgcccacactgggcccagcctgggtgaacatgtacggctccacacgtaactacacgctgctggatgagcatcaggacctgaacgagggcctgggggagggtgtgtccttccgggcccggctcctgctgggcctggctgtggagatcgtagacacctccaaccctgagctcaccagctccacagaggtgcaggtggagcaggccacgcccatctcggagagctgtgcaggtaaaatggaagaattctttctctttggagccttcctggaggcctcaatgatcgaccggagaaacggagacaagcccatcacctttgaggtcaccataggcaactatgggaacgaagttgatggcctgtcccggccccagcggcctcggccccggaaggagccgggggatgaggaagaagtagacctgattcagaacgcaagtgatgacgaggccggtgatgccggggacctggcctcagtctcctccactccaccaatgcggccccaggtcaccgacaggaactacttccatctgccctacctggagcgaaagccctgcatctacatcaagagctggtggccggaccagcgccgccgcctctacaatgccaacatcatggaccacattgccgacaagctggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgaggtaagtatcaaggttacaagacaggtttaaggagaccaatagaaactgggcttgtcgagacagagaagactcttgcgtttctgggattttgccgatttcggcctattggttaaaaaatgagctgatttaacaaaaatttaacgcgaattttaacaaaataagcttgaattcagctgacgtgcctcggaccgcctaggaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggccaa

SEQ ID NO: 97 - DNA, 145 bp, synthetic construct
  source 1..145: mol_type = other DNA
ttggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttcct

SEQ ID NO: 98 - DNA, 381 bp, synthetic construct
  source 1..381: mol_type = other DNA
gacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggactatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatgg

SEQ ID NO: 99 - DNA, 279 bp, synthetic construct
  source 1..279: mol_type = other DNA
gtcgaggtgagccccacgttctgcttcactctccccatctcccccccctccccacccccaattttgtatttatttattttttaattattttgtgcagcgatgggggcggggggggggggggggcgcgcgccaggcggggcggggcggggcgaggggcggggcggggcgaggcggagaggtgcggcggcagccaatcagagcggcgcgctccgaaagtttccttttatggcgaggcggcggcggcggcggccctataaaaagcgaagcgcgcggcgggcg

SEQ ID NO: 100 - DNA, 1013 bp, synthetic construct
  source 1..1013: mol_type = other DNA
ggagtcgctgcgttgccttcgccccgtgccccgctccgcgccgcctcgcgccgcccgccccggctctgactgaccgcgttactcccacaggtgagcgggcgggacggcccttctcctccgggctgtaattagcgcttggtttaatgacggctcgtttcttttctgtggctgcgtgaaagccttaaagggctccgggagggccctttgtgcgggggggagcggctcggggggtgcgtgcgtgtgtgtgtgcgtggggagcgccgcgtgcggcccgcgctgcccggcggctgtgagcgctgcgggcgcggcgcggggctttgtgcgctccgcgtgtgcgcgaggggagcgcggccgggggcggtgccccgcggtgcgggggggctgcgaggggaacaaaggctgcgtgcggggtgtgtgcgtgggggggtgagcagggggtgtgggcgcggcggtcgggctgtaacccccccctgcacccccctccccgagttgctgagcacggcccggcttcgggtgcggggctccgtgcggggcgtggcgcggggctcgccgtgccgggcggggggtggcggcaggtgggggtgccgggcggggcggggccgcctcgggccggggagggctcgggggaggggcgcggcggcccccggagcgccggcggctgtcgaggcgcggcgagccgcagccattgccttttatggtaatcgtgcgagagggcgcagggacttcctttgtcccaaatctgtgcggagccgaaatctgggaggcgccgccgcaccccctctagcgggcgcggggcgaagcggtgcggcgccggcaggaaggaaatgggcggggagggccttcgtgcgtcgccgcgccgccgtccccttctccctctccagcctcggggctgtccgcggggggacggctgccttcgggggggacggggcagggcggggttcggcttctggcgtgtgaccggcggctctagagcctctgctaaccatgttcatgccttcttctttttcctacag

SEQ ID NO: 101 - DNA, 2523 bp, synthetic construct
  source 1..2523: mol_type = other DNA
atggccttgctcatccacctcaagacagtctcggagctgcggggcaggggcgaccggatcgccaaagtgactttccgagggcaatccttctactctcgggtcctggagaactgtgaggatgtggctgactttgatgagacatttcggtggccggtggccagcagcatcgacagaaatgagatgctggagattcaggttttcaactacagcaaagtcttcagcaacaagctcatcgggaccttccgcatggtgctgcagaaggtggtagaggagagccatgtggaggtgactgacacgctgattgatgacaacaatgctatcatcaagaccagcctgtgcgtggaggtccggtatcaggccactgacggcacagtgggctcctgggacgatggggacttcctgggagatgagtctcttcaagaggaagagaaggacagccaagagacggatggactgctcccaggctcccggcccagctcccggcccccaggagagaagagcttccggagagccgggaggagcgtgttctccgccatgaagctcggcaaaaacaggtctcacaaggaggagccccaaagaccagatgaaccggcggtgctggagatggaagaccttgaccatctggccattcggctaggagatggactggatcccgactcggtgtctctagcctcagtcacagctctcaccactaatgtctccaacaagcgatctaagccagacattaagatggagccaagtgctgggcggcccatggattaccaggtcagcatcacggtgatcgaggcccggcagctggtgggcttgaacatggaccctgtggtgtgcgtggaggtgggtgacgacaagaagtacacatccatgaaggagtccactaactgcccctattacaacgagtacttcgtcttcgacttccatgtctctccggatgtcatgtttgacaagatcatcaagatttcggtgattcactccaagaacctgctgcgcagtggcaccctggtgggctccttcaaaatggacgtgggaaccgtgtactcgcagccagagcaccagttccatcacaagtgggccatcctgtctgaccccgatgacatctcctcggggctgaagggctacgtgaagtgtgacgttgccgtggtgggcaaaggggacaacatcaagacgccccacaaggccaatgagaccgacgaagatgacattgaggggaacttgctgctccccgagggggtgccccccgaacgccagtgggcccggttctatgtgaaaatttaccgagcagaggggctgccccgtatgaacacaagcctcatggccaatgtaaagaaggctttcatcggtgaaaacaaggacctcgtggacccctacgtgcaagtcttctttgctggccagaagggcaagacttcagtgcagaagagcagctatgagcccctgtggaatgagcaggtcgtctttacagacctcttccccccactctgcaaacgcatgaaggtgcagatccgagactcggacaaggtcaacgacgtggccatcggcacccacttcattgacctgcgcaagatttctaatgacggagacaaaggcttcctgcccacactgggcccagcctgggtgaacatgtacggctccacacgtaactacacgctgctggatgagcatcaggacctgaacgagggcctgggggagggtgtgtccttccgggcccggctcctgctgggcctggctgtggagatcgtagacacctccaaccctgagctcaccagctccacagaggtgcaggtggagcaggccacgcccatctcggagagctgtgcaggtaaaatggaagaattctttctctttggagccttcctggaggcctcaatgatcgaccggagaaacggagacaagcccatcacctttgaggtcaccataggcaactatgggaacgaagttgatggcctgtcccggccccagcggcctcggccccggaaggagccgggggatgaggaagaagtagacctgattcagaacgcaagtgatgacgaggccggtgatgccggggacctggcctcagtctcctccactccaccaatgcggccccaggtcaccgacaggaactacttccatctgccctacctggagcgaaagccctgcatctacatcaagagctggtggccggaccagcgccgccgcctctacaatgccaacatcatggaccacattgccgacaagctggaagaaggcctgaacgacatacaggagatgatcaaaacggagaagtcctaccctgagcgtcgcctgcggggcgtcctggaggagctgagctgtggctgctgccgcttcctctccctcgctgacaaggaccagggccactcatcccgcaccaggcttgaccgggagcgcctcaagtcctgcatgagggagctggaaaacatggggcagcaggccaggatgctgcgggcccaggtgaagcggcacacggtgcgggacaagctgaggctgtgccagaacttcctgcagaagctgcgcttcctggcggacgag

SEQ ID NO: 102 - DNA, 82 bp, synthetic construct; identical to SEQ ID NO: 64
  source 1..82: mol_type = other DNA

SEQ ID NO: 103 - DNA, 77 bp, synthetic construct; identical to SEQ ID NO: 66
  source 1..77: mol_type = other DNA

SEQ ID NO: 104 - DNA, 145 bp, synthetic construct
  source 1..145: mol_type = other DNA
aggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggccaa

SEQ ID NO: 105 - DNA, 4195 bp, synthetic construct
  source 1..4195: mol_type = other DNA
ttggccactccctctctgcgcgctcgctcgctcactgaggccgcccgggcaaagcccgggcgtcgggcgacctttggtcgcccggcctcagtgagcgagcgagcgcgcagagagggagtggccaactccatcactaggggttcctttgtcgacgcggccgcacgcgtgggattttgccgatttcggcctattggttaaaaaatgagctgatttaacaaaaatttaacgcgaattttaacaaaatgataggcacctattggtcttactgacatccactttgcctttctctccacagccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacggtcaggcttctccggcgctgccgtgtgctgtgcaatgggggctcctcctctcactccacaggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggcatgaactagtgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggaagcttgaattcagctgacgtgcctcggaccgcctaggaggaacccctagtgatggagttggccactccctctctgcgcgctcgctcgctcactgaggccgggcgaccaaaggtcgcccgacgcccgggctttgcccgggcggcctcagtgagcgagcgagcgcgcagagagggagtggccaa

SEQ ID NO: 106 - DNA, 51 bp, synthetic construct; identical to SEQ ID NO: 65
  source 1..51: mol_type = other DNA

SEQ ID NO: 107 - DNA, 3468 bp, synthetic construct
  source 1..3468: mol_type = other DNA
ccccagcacagcattcccgacatcttcatctggatgatgagcaacaacaagcgtgtcgcctatgcccgtgtgccctccaaggacctgctcttctccatcgtggaggaggagactggcaaggactgcgccaaggtcaagacgctcttccttaagctgccagggaagcggggcttcggctcggcaggctggacagtgcaggccaaggtggagctgtacctgtggctgggcctcagcaaacagcgcaaggagttcctgtgcggcctgccctgtggcttccaggaggtcaaggcagcccagggcctgggcctgcatgccttcccacccgtcagcctggtctacaccaagaagcaggcgttccagctccgagcgcacatgtaccaggcccgcagcctctttgccgccgacagcagcggactctcagacccctttgcccgcgtcttcttcatcaatcagagtcagtgcacagaggtgctgaatgagaccctgtgtcccacctgggaccagatgctggtgttcgacaacctggagctctatggtgaagctcatgagctgagggacgatccgcccatcattgtcattgaaatctatgaccaggattccatgggcaaagctgacttcatgggccggaccttcgccaaacccctggtgaagatggcagacgaggcgtactgcccaccccgcttcccacctcagctcgagtactaccagatctaccgtggcaacgccacagctggagacctgctggcggccttcgagctgctgcagattggaccagcagggaaggctgacctgccccccatcaatggcccggtggacgtggaccgaggtcccatcatgcccgtgcccatgggcatccggcccgtgctcagcaagtaccgagtggaggtgctgttctggggcctacgggacctaaagcgggtgaacctggcccaggtggaccggccacgggtggacatcgagtgtgcagggaagggggtgcagtcgtccctgatccacaattataagaagaaccccaacttcaacaccctcgtcaagtggtttgaagtggacctcccagagaacgagctgctgcacccgcccttgaacatccgtgtggtggactgccgggccttcggtcgctacacactggtgggctcccatgccgtcagctccctgcgacgcttcatctaccggcccccagaccgctcggcccccagctggaacaccacggtcaggcttctccggcgctgccgtgtgctgtgcaatgggggctcctcctctcactccacaggggaggttgtggtgactatggagccagaggtacccatcaagaaactggagaccatggtgaagctggacgcgacttctgaagctgttgtcaaggtggatgtggctgaggaggagaaggagaagaagaagaagaagaagggcactgcggaggagccagaggaggaggagccagacgagagcatgctggactggtggtccaagtactttgcctccattgacaccatgaaggagcaacttcgacaacaagagccctctggaattgacttggaggagaaggaggaagtggacaataccgagggcctgaaggggtcaatgaagggcaaggagaaggcaagggctgccaaagaggagaagaagaagaaaactcagagctctggctctggccaggggtccgaggcccccgagaagaagaaacccaagattgatgagcttaaggtataccccaaagagctggagtccgagtttgataactttgaggactggctgcacactttcaacttgcttcggggcaagaccggggatgatgaggatggctccaccgaggaggagcgcattgtgggacgcttcaagggctccctctgcgtgtacaaagtgccactcccagaggacgtgtcccgggaagccggctacgactccacctacggcatgttccagggcatcccgagcaatgaccccatcaatgtgctggtccgagtctatgtggtccgggccacggacctgcaccctgctgacatcaacggcaaagctgacccctacatcgccatccggctaggcaagactgacatccgcgacaaggagaactacatctccaagcagctcaaccctgtctttgggaagtcctttgacatcgaggcctccttccccatggaatccatgctgacggtggctgtgtatgactgggacctggtgggcactgatgacctcattggggaaaccaagatcgacctggagaaccgcttctacagcaagcaccgcgccacctgcggcatcgcccagacctactccacacatggctacaatatctggcgggaccccatgaagcccagccagatcctgacccgcctctgcaaagacggcaaagtggacggcccccactttgggccccctgggagagtgaaggtggccaaccgcgtcttcactgggccctctgagattgaggacgagaacggtcagaggaagcccacagacgagcatgtggcgctgttggccctgaggcactgggaggacatcccccgcgcaggctgccgcctggtgccagagcatgtggagacgaggccgctgctcaaccccgacaagccgggcatcgagcagggccgcctggagctgtgggtggacatgttccccatggacatgccagcccctgggacgcctctggacatctcacctcggaagcccaagaagtacgagctgcgggtcatcatctggaacacagatgaggtggtcttggaggacgacgacttcttcacaggggagaagtccagtgacatcttcgtgagggggtggctgaagggccagcaggaggacaagcaggacacagacgtccactaccactccctcactggcgagggcaacttcaactggcgctacctgttccccttcgactacctggcggcggaggagaagatcgtcatctccaagaaggagtccatgttctcctgggacgagaccgagtacaagatccccgcgcggctcaccctgcagatctgggatgcggaccacttctccgctgacgacttcctgggggccatcgagctggacctgaaccggttcccgcggggcgcaaagacagccaagcagtgcaccatggagatggccaccggggaggtggacgtgcccctcgtgtccatcttcaagcaaaagcgcgtcaaaggctggtggcccctcctggcccgcaatgagaacgatgagtttgagctcacgggcaaggtggaggctgagctgcatttactgacagcagaggaggcagagaagaacccagtgggcctggcccgcaatgaacctgaccccctagagaaacccaaccggcccgacacggccttcgtctggttcctcaaccctctcaagtccatcaagtacctcatctgcacccggtacaagtggctcatcatcaagatcgtgctggcgctgttggggctgctcatgttggggctcttcctctacagcctccctggctacatggtcaaaaagctccttggggca

SEQ ID NO: 108 - DNA, 225 bp, synthetic construct
  source 1..225: mol_type = other DNA
ctgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatgg

SEQ ID NO: 109 - protein, 736 aa, synthetic construct
MAADGYLPDWLEDNLSEGIREWWDLKPGAPKPKANQQKQDDGRGLVLPGYKYLGPFNGLDKGEPVNAADAAALEHDKAYDQQLKAGDNPYLRYNHADAEFQERLQEDTSFGGNLGRAVFQAKKRVLEPLGLVEEGAKTAPGKKRPVEQSPQEPDSSSGIGKKGQQPARKRLNFGQTGDSESVPDPQPLGEPPAAPSGVGSNTMAAGGGAPMADNNEGADGVGNASGNWHCDSTWLGDRVITTSTRTWALPTYNNHLYKQISSQSGGSTNDNTYFGYSTPWGYFDFNRFHCHFSPRDWQRLINNNWGFRPKKLNFKLFNIQVKEVTTNDGTTTIANNLTSTVQVFTDSEYQLPYVLGSAHQGCLPPFPADVFMIPQYGYLTLNNGSQAVGRSSFYCLEYFPSQMLRTGNNFQFSYTFEDVPFHSSYAHSQSLDRLMNPLIDQYLYYLSRTQTTSGTAGNRTLQFSQAGPSSMANQAKNWLPGPCYRQQRVSKTTNQNNNSNFAWTGATKYHLNGRDSLVNPGPAMATHKDDEDKFFPMSGVLIFGKQGAGNSNVDLDNVMITNEEEIKTTNPVATEEYGTVATNLQSANTAPATGTVNSQGALPGMVWQDRDVYLQGPIWAKIPHTDGHFHPSPLMGGFGLKHPPPQILIKNTPVPANPPTTFSPAKFASFITQYSTGQVSVEIEWELQKENSKRWNPEIQYTSNYNKSTNVDFAVDTNGVYSEPRPIGTRYLTRNL

SEQ ID NO: 110 - DNA, 50 bp, synthetic construct
  source 1..50: mol_type = other DNA
ataggcacctattggtcttactgacatccactttgcctttctctccacag

What is claimed is:

1. A plurality of recombinant adeno-associated viral (rAAV) vectors comprising:
    a) a first rAAV vector comprising a nucleic acid sequence of SEQ ID NO: 96; and
    b) a second rAAV vector comprising a nucleic acid sequence of SEQ ID NO: 105.

2. The plurality of rAAV vectors of claim 1, wherein the first and second rAAV vectors are each encapsulated by an AAV capsid.

3. The plurality of rAAV vectors of claim 2, wherein the AAV capsid encapsulating the first rAAV vector is a serotype selected from any one of AAV1, AAV2, AAV3, AAV4, AAV5, AAV6, AAV7, AAV8, AAV9, AAVrh8, AAVrh10, AAVrh39, AAVrh43, or Anc80.

4. The plurality of rAAV vectors of claim 2, wherein the AAV capsid encapsulating the second rAAV vector is a serotype selected from any one of AAV1, AAV2, AAV3, AAV4, AAV5, AAV6, AAV7, AAV8, AAV9, AAVrh8, AAVrh10, AAVrh39, AAVrh43, or Anc80.

5. The plurality of rAAV vectors of claim 2, wherein the first rAAV vector is encapsulated by an Anc80 capsid and the second rAAV vector is encapsulated by an Anc80 capsid.

6. The plurality of rAAV vectors of claim 5, wherein the Anc80 capsids comprise the polypeptide sequence of SEQ ID NO: 109.

7. A composition comprising the plurality of rAAV vectors of claim 1, wherein the composition further comprises one or more pharmaceutically acceptable carriers, diluents, or excipients.

8. The composition of claim 7, wherein the composition is formulated for intra-cochlear administration.

9. The composition of claim 8, wherein the composition is formulated to comprise a synthetic perilymph solution.

10. A method of expressing a recombinant full-length otoferlin protein in a mammalian cell, the method comprising administering a plurality of recombinant adeno-associated viral (rAAV) vectors comprising:
    a) a first rAAV vector comprising a nucleic acid sequence of SEQ ID NO: 96; and
    b) a second rAAV vector comprising a nucleic acid sequence of SEQ ID NO: 105;
    to the mammalian cell, wherein the mammalian cell has reduced expression, lack of expression or dysfunction of otoferlin.

11. The method of claim 10, wherein the mammalian cell is an inner hair cell.

12. The method of claim 10, wherein the mammalian cell is a human cell.

13. The method of claim 10, wherein the mammalian cell comprises a defective otoferlin gene.

14. The method of claim 10, wherein the first and second rAAV vectors are each encapsulated by an AAV capsid.

15. The method of claim 14, wherein the AAV capsid encapsulating the first rAAV vector is a serotype selected from any one of AAV1, AAV2, AAV3, AAV4, AAV5, AAV6, AAV7, AAV8, AAV9, AAVrh8, AAVrh10, AAVrh39, AAVrh43, or Anc80.

16. The method of claim 14, wherein the AAV capsid encapsulating the second rAAV vector is a serotype selected from any one of AAV1, AAV2, AAV3, AAV4, AAV5, AAV6, AAV7, AAV8, AAV9, AAVrh8, AAVrh10, AAVrh39, AAVrh43, or Anc80.

17. The method of claim 14, wherein the first rAAV vector is encapsulated by an Anc80 capsid and the second rAAV vector is encapsulated by an Anc80 capsid.

18. The method of claim 16, wherein the Anc80 capsids comprise the polypeptide sequence of SEQ ID NO: 109.

19. A method of treating hearing loss in a subject having otoferlin related hearing loss, the method comprising administering a plurality of recombinant adeno-associated viral (rAAV) vectors comprising:
   a) a first rAAV vector comprising a nucleic acid sequence of SEQ ID NO: 96; and
   b) a second rAAV vector comprising a nucleic acid sequence of SEQ ID NO: 105;
   into the cochlea of the subject, wherein the subject has reduced expression, lack of expression, or dysfunction of otoferlin.

20. The method of claim 19, wherein the subject is a human.

21. The method of claim 19, wherein the first and second rAAV vectors are each encapsulated by an AAV capsid.

22. The method of claim 21, wherein the AAV capsid encapsulating the first rAAV vector is a serotype AAV1, AAV2, AAV3, AAV4, AAV5, AAV6, AAV7, AAV8, AAV9, AAVrh8, AAVrh10, AAVrh39, AAVrh43, or Anc80.

23. The method of claim 21, wherein the AAV capsid encapsulating the second rAAV vector is a serotype AAV1, AAV2, AAV3, AAV4, AAV5, AAV6, AAV7, AAV8, AAV9, AAVrh8, AAVrh10, AAVrh39, AAVrh43, or Anc80.

24. The method of claim 21, wherein the first rAAV vector is encapsulated by an Anc80 capsid and the second rAAV vector is encapsulated by an Anc80 capsid.

25. The method of claim 24, wherein the Anc80 capsids comprise the polypeptide sequence of SEQ ID NO: 109.

26. The method of claim 19, wherein the plurality of rAAV vectors is administered as a single dose.

27. The method of claim 19, wherein the plurality of rAAV vectors is administered as two or more doses.

28. The method of claim 19, wherein the subject has a defective otoferlin gene.

* * * * *